United States Patent
Gong et al.

(10) Patent No.: US 11,713,461 B2
(45) Date of Patent: Aug. 1, 2023

(54) TREATMENT OF DECREASED BONE MINERAL DENSITY WITH ZINC AND RING FINGER 3 (ZNRF3) INHIBITORS

(71) Applicants: Regeneron Pharmaceuticals, Inc., Tarrytown, NY (US); University of Maryland, Baltimore, Baltimore, MD (US)

(72) Inventors: Da-Wei Gong, Baltimore, MD (US); Nehal Gosalia, Tarrytown, NY (US); Alan Shuldiner, Tarrytown, NY (US); Cristopher Van Hout, Tarrytown, NY (US); James Perry, Baltimore, MD (US)

(73) Assignees: Regeneran Pharmaceuticals, Inc., Tarrytown, NY (US); University of Maryland, Baltimore, Baltimore, MD (US)

( * ) Notice: Subject to any disclaimer, the term of this patent is extended or adjusted under 35 U.S.C. 154(b) by 320 days.

(21) Appl. No.: 16/907,678

(22) Filed: Jun. 22, 2020

(65) Prior Publication Data
US 2021/0002647 A1    Jan. 7, 2021

Related U.S. Application Data

(60) Provisional application No. 62/930,149, filed on Nov. 4, 2019, provisional application No. 62/864,903, filed on Jun. 21, 2019.

(51) Int. Cl.
*C12N 15/113* (2010.01)
*A61P 19/10* (2006.01)
*C12Q 1/6874* (2018.01)

(52) U.S. Cl.
CPC .......... *C12N 15/1137* (2013.01); *A61P 19/10* (2018.01); *C12Q 1/6874* (2013.01)

(58) Field of Classification Search
CPC ............. C12N 15/113; C12N 15/1137; C12Q 1/6874; C12Q 1/6883; A61P 19/08; A61P 19/10
USPC ..................... 435/6.1, 91.1, 91.31, 455, 458; 514/44 A, 44 R; 536/23.1, 24.5
See application file for complete search history.

(56) References Cited

FOREIGN PATENT DOCUMENTS

| WO | 2013054307 | 4/2013 |
|----|-----------|--------|
| WO | 2013130364 | 9/2013 |

OTHER PUBLICATIONS

Roberts et al (Nature Reviews: Drug Discovery, vol. 19, pp. 673-694 (2020)) (Year: 2020).*
Damase et al (Frontiers in Bioengineering and Biotech., vol. 9, article 628137, pp. 1-24 (2021)) (Year: 3021).*
Kichaev et al., "Leveraging Polygenic Functional Enrichment to Improve GWAS Power", The American Journal of Human Genetics, 2019, 104, pp. 65-75.
Kim, "Indentifcation of 613 new loci associated with heel bone mineral density and a polygenic risk score for bone mineral density, osteoporosis and fracture", PloS ONE, 2018, 13, e0200785, pp. 1-20.
Morris et al., "An atlas of genetic influences on osteoporosis in humans and mice", Nat Genet, 2019, 51(2), pp. 258-266.
Hao et al., "ZNRF3 promotes Wnt receptor turnover in an R-spondin-sensitive manner", Nature, 2012, 485(7397), pp. 195-202.
Madan et al., "Targeting Wnts at the Source—New Mechanisms, New Biomarkers, New Drugs", Molecular Cancer Therapeutics, 2015, 14(5), pp. 1087-1094.
Wagner et al., "The therapeutic potential of the Wnt signaling pathway in bone disorders", Current Molecular Pharmacology, 2011, 4(1), pp. 14-25.
International Search Report and Written Opinion dated Oct. 28, 2020 for International Patent Application No. PCT/US2020/038917.

* cited by examiner

*Primary Examiner* — Jane J Zara
(74) *Attorney, Agent, or Firm* — Armstrong Teasdale LLP

(57) ABSTRACT

The present disclosure provides methods of treating patients having decreased bone mineral density, methods of identifying subjects having increased risk of developing decreased bone mineral density, methods of detecting human Zinc And Ring Finger 3 (ZNRF3) variant nucleic acid molecules and variant polypeptides, and ZNRF3 variant nucleic acid molecules and variant polypeptides.

15 Claims, 7 Drawing Sheets
Specification includes a Sequence Listing.

TREATMENT OF DECREASED BONE MINERAL DENSITY WITH ZINC AND RING FINGER 3 (ZNRF3) INHIBITORS

REFERENCE TO GOVERNMENT GRANTS

This invention was made with government support under Grant Nos. AR046838 and HL072515 awarded by the National Institutes of Health. The government has certain rights in the invention.

REFERENCE TO SEQUENCE LISTING

This application includes a Sequence Listing submitted electronically as a text file named 18923802601SEQ, created on Jun. 17, 2020, with a size of 805 kilobytes. The Sequence Listing is incorporated herein by reference.

FIELD

The present disclosure relates generally to the treatment of patients having decreased bone mineral density with Zinc And Ring Finger 3 (ZNRF3) inhibitors, methods of identifying subjects having an increased risk of developing decreased bone mineral density, methods of detecting ZNRF3 variant nucleic acid molecules and variant polypeptides, and ZNRF3 variant nucleic acid molecules and ZNRF3 variant polypeptides.

BACKGROUND

Loss of bone mineral content can be caused by a wide variety of conditions and may result in significant medical problems. For example, osteoporosis is a debilitating disease in humans and is characterized by marked decreases in skeletal bone mass and mineral density, structural deterioration of bone, including degradation of bone microarchitecture and corresponding increases in bone fragility (i.e., decreases in bone strength), and susceptibility to fracture in afflicted individuals. Osteoporosis in humans is generally preceded by clinical osteopenia, a condition found in approximately 25 million people in the United States. Another 7-8 million patients in the United States have been diagnosed with clinical osteoporosis. The frequency of osteoporosis in the human population increases with age. Among Caucasians, osteoporosis is predominant in women who, in the United States, comprise 80% of the osteoporosis patient pool. The increased fragility and susceptibility to fracture of skeletal bone in the aged is aggravated by the greater risk of accidental falls in this population. Fractured hips, wrists, and vertebrae are among the most common injuries associated with osteoporosis. Hip fractures, in particular, are extremely uncomfortable and expensive for the patient, and for women, correlate with high rates of mortality and morbidity.

Wnt signaling pathways are a network of proteins in eukaryotic cells that are important for regulating cell growth and differentiation. Logan and Nusse, Annu. Rev. Cell. Dev. Biol., 2004, 20, 781-810; Nusse, Cell Res., 2005, 15, 28-32; and Clevers, Cell, 2006, 127, 469-80. Wnt signaling is essential for regulating cell growth and differentiation during embryonic development. In adults, Wnt signaling promotes tissue homeostasis.

Dysregulation of Wnt signaling has been implicated in many human diseases. Aberrant over-activation of Wnt pathway can be involved in causing tumorigenesis of colorectal carcinomas. Conversely, pathologically low levels of Wnt signaling have been associated with osteoporosis, osteoarthritis, polycystic kidney disease and neurodegenerative diseases. Controlled activation of Wnt pathway has been shown to promote regenerative processes such as tissue repair and wound-healing. Zhao et al., Trends Biotechnol., 2009, 27, 131-6.

Wnt proteins are protein ligands that bind to cell surface receptors (the "Wnt receptor complex") to activate Wnt pathways in a cell. Several kinds of Wnt pathways have been identified, both canonical and non-canonical. Wnt signaling through a canonical Wnt/β-catenin pathway regulates the cellular turnover of the transcription cofactor protein β-catenin (MacDonald et al., Dev. Cell, 2009, 17, 9-26; and U.S. Patent Application Publication 2009/0220488). In the absence of Wnt ligands, β-catenin remains phosphorylated by a multi-protein "destruction complex", which triggers polyubiquitination of the β-catenin and degradation of β-catenin in the proteosomes of the cell. When Wnt binds to the Wnt receptor complex, β-catenin is stabilized through inhibition of the "destruction complex." The β-catenin then translocates to the nucleus. In the nucleus, β-catenin activates transcription of Wnt target genes and, thus, activates the gene expression programs for cell growth and differentiation.

In the canonical Wnt/β-catenin pathway, Frizzled (FZD) proteins and Low-Density-Lipoprotein Receptor-Related Protein 5/6 (LRP5/6) form the receptor complex. Both Frizzled proteins and LRP5/6 are important for the canonical Wnt/β-catenin pathway.

In a non-canonical, β-catenin independent pathway, Wnt signaling regulates planar cell polarity (PCP) or tissue polarity signaling, which governs cells and tissue movements (Zallen, Cell, 2007, 129, 1051-63; Simons et al., Annu. Rev. Genet., 2008, 42, 517-40; and U.S. Patent Application Publication 2009/0220488). Frizzled proteins are receptors in the non-canonical Wnt signaling, but LRP5/6 is not essential.

Despite the many proteins that are involved in Wnt signaling pathways, few druggable targets in the pathway have been identified, especially targets upstream in the pathway of β-catenin in the Wnt pathway.

Zinc And Ring Finger 3 (ZNRF3) is an E3 ubiquitin-protein ligase that acts as a negative regulator of the Wnt signaling pathway by mediating the ubiquitination and subsequent degradation of Wnt receptor complex components Frizzled and LRP6. A homologous protein, Ring finger protein 43 (RNF43) is also found in mice. ZNRF3 acts on both canonical and non-canonical Wnt signaling pathway. ZNRF3 also acts as a tumor suppressor in the intestinal stem cell zone by inhibiting the Wnt signaling pathway, thereby restricting the size of the intestinal stem cell zone.

SUMMARY

The present disclosure provides methods of treating a patient having decreased bone mineral density, the method comprising administering a ZNRF3 inhibitor to the patient.

The present disclosure also provides methods of treating a patient with a therapeutic agent that treats or inhibits decreased bone mineral density, wherein the patient is suffering from decreased bone mineral density, the method comprising the steps of: determining whether the patient has a ZNRF3 predicted loss-of-function variant nucleic acid molecule encoding a human ZNRF3 polypeptide by: i) obtaining or having obtained a biological sample from the patient; and ii) performing or having performed a genotyping assay on the biological sample to determine if the patient has a genotype comprising the ZNRF3 predicted loss-of-function variant nucleic acid molecule; and when the patient is ZNRF3 reference, then administering or continuing to administer to the patient the therapeutic agent that treats or inhibits decreased bone mineral density in a standard dosage amount, and administering to the patient a ZNRF3 inhibitor; and when the patient is heterozygous for a ZNRF3 predicted loss-of-function variant, then administering or continuing to administer to the patient the therapeutic agent that treats or inhibits decreased bone mineral density in an amount that is the same as or lower than a standard dosage amount, and administering to the patient a ZNRF3 inhibitor; wherein the presence of a genotype having the ZNRF3 predicted loss-of-function variant nucleic acid molecule encoding the human ZNRF3 polypeptide indicates the patient has a reduced risk of developing decreased bone mineral density; and wherein the ZNRF3 predicted loss-of-function variant is: a genomic nucleic acid molecule having a nucleotide sequence comprising a deletion of the position corresponding to position 167,122 according to SEQ ID NO:1; an mRNA molecule having a nucleotide sequence comprising a deletion of the position corresponding to position 2,707 according to SEQ ID NO:4, or a deletion of the position corresponding to position 2,397 according to SEQ ID NO:5; a cDNA molecule produced from an mRNA molecule in the biological sample, wherein the cDNA molecule has a nucleotide sequence comprising a deletion of the position corresponding to position 2,707 according to SEQ ID NO:10, or a deletion of the position corresponding to positions 2,397 according to SEQ ID NO:11; a genomic nucleic acid molecule having a nucleotide sequence comprising a guanine at a position corresponding to position 166,500 according to SEQ ID NO:3; an mRNA molecule having a nucleotide sequence comprising a guanine at a position corresponding to position 2,085 according to SEQ ID NO:8, or a guanine at a position corresponding to positions 1,175 according to SEQ ID NO:9; or a cDNA molecule produced from an mRNA molecule in the biological sample, wherein the cDNA molecule has a nucleotide sequence comprising a guanine at a position corresponding to position 2,085 according to SEQ ID NO:14, or a guanine at a position corresponding to position 1,175 according to SEQ ID NO:15.

The present disclosure also provides methods of identifying a human subject having an increased risk for developing decreased bone mineral density, wherein the method comprises determining or having determined the presence or absence of a ZNRF3 predicted loss-of-function variant nucleic acid molecule encoding a human ZNRF3 polypeptide in a biological sample obtained from the subject; wherein: when the human subject is ZNRF3 reference, then the human subject has an increased risk for developing decreased bone mineral density, and when the human subject is heterozygous for a ZNRF3 predicted loss-of-function variant or homozygous ZNRF3 predicted loss-of-function variant, then the human subject has a decreased risk for developing decreased bone mineral density; wherein the ZNRF3 predicted loss-of-function variant is: a genomic nucleic acid molecule having a nucleotide sequence comprising a deletion of the position corresponding to position 167,122 according to SEQ ID NO:1; an mRNA molecule having a nucleotide sequence comprising a deletion of the position corresponding to position 2,707 according to SEQ ID NO:4, or a deletion of the position corresponding to position 2,397 according to SEQ ID NO:5; a cDNA molecule produced from an mRNA molecule in the biological sample, wherein the cDNA molecule has a nucleotide sequence comprising a deletion of the position corresponding to position 2,707 according to SEQ ID NO:10, or a deletion of the position corresponding to position 2,397 according to SEQ ID NO:11; a genomic nucleic acid molecule having a nucleotide sequence comprising a guanine at a position corresponding to position 166,500 according to SEQ ID NO:3; an mRNA molecule having a nucleotide sequence comprising a guanine at a position corresponding to position 2,085 according to SEQ ID NO:8, or a guanine at a position corresponding to positions 1,175 according to SEQ ID NO:9; or a cDNA molecule produced from an mRNA molecule in the biological sample, wherein the cDNA molecule has a nucleotide sequence comprising a guanine at a position corresponding to position 2,085 according to SEQ ID NO:14, or a guanine at a position corresponding to position 1,175 according to SEQ ID NO:15.

The present disclosure also provides methods of detecting a human ZNRF3 predicted loss-of-function variant nucleic acid molecule in a human subject comprising assaying a sample obtained from the human subject to determine whether a nucleic acid molecule in the sample, or a cDNA molecule produced from an mRNA molecule in the sample, comprises a nucleotide sequence comprising: a deletion of the position corresponding to position 167,122 according to SEQ ID NO:1; a deletion of the position corresponding to position 2,707 according to SEQ ID NO:4; a deletion of the position corresponding to position 2,397 according to SEQ ID NO:5; a deletion of the position corresponding to position 2,707 according to SEQ ID NO:10; a deletion of the position corresponding to positions 2,397 according to SEQ ID NO:11; a guanine at a position corresponding to position 166,500 according to SEQ ID NO:3; a guanine at a position corresponding to position 2,085 according to SEQ ID NO:8; a guanine at a position corresponding to positions 1,175 according to SEQ ID NO:9; a guanine at a position corresponding to position 2,085 according to SEQ ID NO:14; or a guanine at a position corresponding to position 1,175 according to SEQ ID NO:15.

The present disclosure also provides alteration-specific probes or alteration-specific primers comprising at least about 15 nucleotides, wherein the alteration-specific probes or alteration-specific primers comprise a nucleotide sequence which is complementary to a portion of a nucleotide sequence encoding a human ZNRF3 polypeptide, wherein the portion comprises a position corresponding to: position 167,123 according to SEQ ID NO:2, or the complement thereof; position 2,708 according to SEQ ID NO:6, or the complement thereof; position 2,398 according to SEQ ID NO:7, or the complement thereof; position 2,708 according to SEQ ID NO:12, or the complement thereof; position 2,398 according to SEQ ID NO:13, or the complement thereof; position 166,500 according to SEQ ID NO:3, or the complement thereof; position 2,085 according to SEQ ID NO:8, or the complement thereof; position 1,775 according to SEQ ID NO:9, or the complement thereof; position 2,085 according to SEQ ID NO:14, or the complement thereof; or position 1,775 according to SEQ ID NO:15, or the complement thereof, wherein the alteration-specific probe or alteration-specific primer comprises a modified base, sugar, or phosphate group, or comprises a detectable label.

The present disclosure also provides molecular complexes comprising an alteration-specific primer or an alteration-specific probe hybridized to a portion of a nucleic acid molecule comprising a nucleotide sequence encoding a human ZNRF3 polypeptide, wherein the portion comprises a position corresponding to: position 167,123 according to SEQ ID NO:2, or the complement thereof; position 2,708 according to SEQ ID NO:6, or the complement thereof; position 2,398 according to SEQ ID NO:7, or the complement thereof; position 2,708 according to SEQ ID NO:12, or the complement thereof; position 2,398 according to SEQ ID NO:13, or the complement thereof; position 166,500 according to SEQ ID NO:3, or the complement thereof; position 2,085 according to SEQ ID NO:8, or the complement thereof; position 1,775 according to SEQ ID NO:9, or the complement thereof; position 2,085 according to SEQ ID NO:14, or the complement thereof; or position 1,775 according to SEQ ID NO:15, or the complement thereof.

The present disclosure also provides cDNA molecules comprising a nucleotide sequence encoding a human ZNRF3 polypeptide, wherein the nucleotide sequence lacks a position corresponding to position 2,707 according to SEQ ID NO:10, or the complement thereof, or lacks a position corresponding to position 2,397 according to SEQ ID NO:11, or the complement thereof.

BRIEF DESCRIPTION OF THE DRAWINGS

The accompanying figures, which are incorporated in and constitute a part of this specification, illustrate several aspects of the present disclosure. The patent or application file contains at least one drawing executed in color. Copies of this patent or patent application publication with color drawing(s) will be provided by the Office upon request and payment of the necessary fee.

DESCRIPTION

Figure 1:
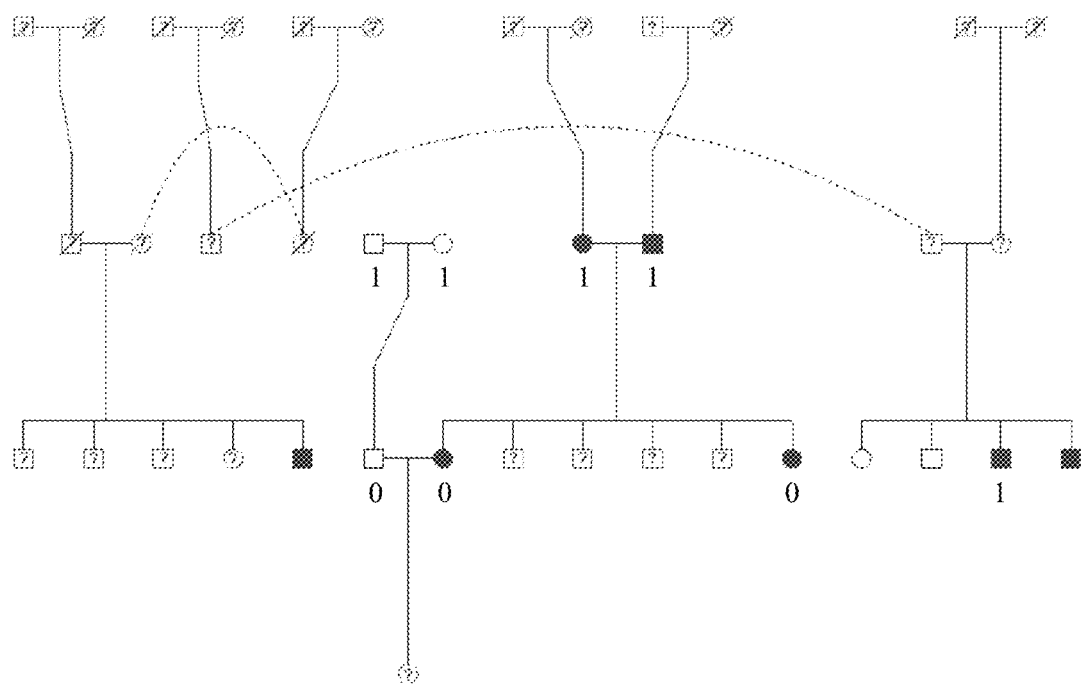
FIG. 1 shows a partial pedigree of the ZNRF3 p.Ser844fs/p.Ser744fs homozygous carriers shown in red; this variant is enriched in Anabaptist Populations and not present in more outbred, cosmopolitan populations.

Various terms relating to aspects of the present disclosure are used throughout the specification and claims. Such terms are to be given their ordinary meaning in the art, unless otherwise indicated. Other specifically defined terms are to be construed in a manner consistent with the definitions provided herein.

Unless otherwise expressly stated, it is in no way intended that any method or aspect set forth herein be construed as requiring that its steps be performed in a specific order. Accordingly, where a method claim does not specifically state in the claims or descriptions that the steps are to be limited to a specific order, it is in no way intended that an order be inferred, in any respect. This holds for any possible non-expressed basis for interpretation, including matters of logic with respect to arrangement of steps or operational flow, plain meaning derived from grammatical organization or punctuation, or the number or type of aspects described in the specification.

As used herein, the singular forms "a," "an" and "the" include plural referents unless the context clearly dictates otherwise.

As used herein, the term "about" means that the recited numerical value is approximate and small variations would not significantly affect the practice of the disclosed embodiments. Where a numerical value is used, unless indicated otherwise by the context, the term "about" means the numerical value can vary by ±10% and remain within the scope of the disclosed embodiments.

As used herein, the term "comprising" may be replaced with "consisting" or "consisting essentially of" in particular embodiments as desired.

As used herein, the term "isolated", in regard to a nucleic acid molecule or a polypeptide, means that the nucleic acid molecule or polypeptide is in a condition other than its native environment, such as apart from blood and/or animal tissue. In some embodiments, an isolated nucleic acid molecule or polypeptide is substantially free of other nucleic acid molecules or other polypeptides, particularly other nucleic acid molecules or polypeptides of animal origin. In some embodiments, the nucleic acid molecule or polypeptide can be in a highly purified form, i.e., greater than 95% pure or greater than 99% pure. When used in this context, the term "isolated" does not exclude the presence of the same nucleic acid molecule or polypeptide in alternative physical forms, such as dimers or alternatively phosphorylated or derivatized forms.

As used herein, the terms "nucleic acid", "nucleic acid molecule", "nucleic acid sequence", "polynucleotide", or "oligonucleotide" can comprise a polymeric form of nucleotides of any length, can comprise DNA and/or RNA, and can be single-stranded, double-stranded, or multiple stranded. One strand of a nucleic acid also refers to its complement.

A rare variant in the ZNRF3 gene associated with a decreased risk of developing decreased bone mineral density or conditions resulting from decreased bone mineral density in human subjects has been identified in accordance with the present disclosure. For example, a genetic alteration that results in the deletion of a guanine at position 167,122 in the human ZNRF3 reference (see, SEQ ID NO:1), or a genetic alteration that results in replacement of the adenine at position 166,500 in the human ZNRF3 reference (see, SEQ ID NO:1) with guanine, has been observed to indicate that the human having such an alteration may have a decreased risk of developing decreased bone mineral density or conditions resulting from decreased bone mineral density. In recent publications, intronic and intergenic variants in and near ZNRF3 were reported to be associated with heel bone mineral density (Kim, PLoS One, 2018, 13, e0200785; Kichaev et al., Am. J. Hum. Genet., 2019, 104, 65-75; and Morris et al., Nat. Genet., 2019, 51, 258-266). It is believed that this is the first report of a predicted loss-of-function, frameshift variant in ZNRF3 associated with increased bone mineral density. Altogether, the genetic analyses described herein surprisingly indicate that the ZNRF3 gene and, in particular, variants in the ZNRF3 gene, associate with a decreased risk of developing decreased bone mineral density or conditions resulting from decreased bone mineral density. Therefore, human subjects that are ZNRF3 reference that have an increased risk of developing decreased bone mineral density or conditions resulting from decreased bone mineral density, such as osteopenia or osteoporosis, may be treated such that decreased bone mineral density is prevented, the symptoms thereof are reduced, and/or development of symptoms is repressed. Accordingly, the present disclosure provides methods of leveraging the identification of such variants in subjects to identify or stratify risk in such subjects of developing decreased bone mineral density or conditions resulting from decreased bone mineral density, such as osteopenia or osteoporosis, or to diagnose subjects as having an increased risk of developing decreased bone mineral density or conditions resulting from decreased bone mineral density, such as osteopenia or osteoporosis, such that subjects at risk or subjects with active disease may be treated accordingly. Also provided herein are ZNRF3 loss-of-function variant nucleic acid molecules discovered to be associated with decreased risk of developing decreased bone mineral density or conditions resulting from decreased bone mineral density, such as osteopenia or osteoporosis. Additionally, the present disclosure provides isolated ZNRF3 variant genomic nucleic acid molecules, variant mRNA molecules, and variant cDNA molecules.

For purposes of the present disclosure, any particular human can be categorized as having one of three ZNRF3 genotypes: i) ZNRF3 reference; ii) heterozygous for a ZNRF3 predicted loss-of-function variant; or iii) homozygous for a ZNRF3 predicted loss-of-function variant. A human is ZNRF3 reference when the human does not have a copy of a ZNRF3 predicted loss-of-function variant nucleic acid molecule. A human is heterozygous for a ZNRF3 predicted loss-of-function variant when the human has a single copy of a ZNRF3 predicted loss-of-function variant nucleic acid molecule. A ZNRF3 predicted loss-of-function variant nucleic acid molecule is any ZNRF3 nucleic acid molecule (such as, a genomic nucleic acid molecule, an mRNA molecule, or a cDNA molecule) encoding a ZNRF3 polypeptide having a partial loss-of-function, a complete loss-of-function, a predicted partial loss-of-function, or a predicted complete loss-of-function. A human who has a ZNRF3 polypeptide having a partial loss-of-function (or predicted partial loss-of-function) is hypomorphic for ZNRF3. The ZNRF3 predicted loss-of-function variant nucleic acid molecule can be any nucleic acid molecule encoding ZNRF3 Ser844FS, Ser744FS, His637Arg, or His537Arg. In some embodiments, the ZNRF3 predicted loss-of-function variant nucleic acid molecule encodes ZNRF3 Ser844FS, Ser744FS, His637Arg, or His537Arg. A human is homozygous for a ZNRF3 predicted loss-of-function variant when the human has two copies of a ZNRF3 predicted loss-of-function variant nucleic acid molecule.

For human subjects or patients that are genotyped or determined to be ZNRF3 reference, such human subjects or patients have an increased risk of developing decreased bone mineral density or conditions resulting from decreased bone mineral density, such as osteopenia or osteoporosis. For human subjects or patients that are genotyped or determined to be either ZNRF3 reference or heterozygous ZNRF3 predicted loss-of-function variant, such human subjects or patients can be treated with a ZNRF3 inhibitor.

The present disclosure provides methods of treating a patient having decreased bone mineral density. In some embodiments, the patient has or is suspected of having osteopenia. In some embodiments, the patient has or is suspected of having osteoporosis. Some examples of causes of osteopenia and osteoporosis for which ZNRF3 inhibitors may be useful include, but are not limited to, low bone mineral density associated with aging and frailty due to older age or chronic disease, chronic glucocorticoid use, calcium or D deficiency, low sex hormones such as in the cases of estrogen deficiency, menopause or treatment with aromatase inhibitors or estrogen antagonists in females or testosterone deficiency in males, hyperparapthyroidism and chronic kidney disease.

In some embodiments, the ZNRF3 inhibitor comprises an antisense molecule. Examples of antisense molecules include, but are not limited to, antisense nucleic acid molecules, small interfering RNAs (siRNAs), and short hairpin RNAs (shRNAs). Such antisense molecules can be designed to target any region of a ZNRF3 mRNA. In some embodiments, the antisense RNA, siRNA, or shRNA hybridizes to a sequence within a ZNRF3 genomic nucleic acid molecule or mRNA molecule and decreases expression of the ZNRF3 polypeptide in a cell in the subject. In some embodiments, the ZNRF3 inhibitor comprises an antisense RNA that hybridizes to a ZNRF3 genomic nucleic acid molecule or mRNA molecule and decreases expression of the ZNRF3 polypeptide in a cell in the subject. In some embodiments, the ZNRF3 inhibitor comprises an siRNA that hybridizes to a ZNRF3 genomic nucleic acid molecule or mRNA molecule and decreases expression of the ZNRF3 polypeptide in a cell in the subject. In some embodiments, the ZNRF3 inhibitor comprises an shRNA that hybridizes to a ZNRF3 genomic nucleic acid molecule or mRNA molecule and decreases expression of the ZNRF3 polypeptide in a cell in the subject.

In some embodiments, the ZNRF3 inhibitor comprises a nuclease agent that induces one or more nicks or double-strand breaks at a recognition sequence(s) or a DNA-binding protein that binds to a recognition sequence within a ZNRF3 genomic nucleic acid molecule. The recognition sequence can be located within a coding region of the ZNRF3 gene, or within regulatory regions that influence the expression of the gene. A recognition sequence of the DNA-binding protein or nuclease agent can be located in an intron, an exon, a promoter, an enhancer, a regulatory region, or any non-protein coding region. The recognition sequence can include or be proximate to the start codon of the ZNRF3 gene. For example, the recognition sequence can be located about 10, about 20, about 30, about 40, about 50, about 100, about 200, about 300, about 400, about 500, or about 1,000 nucleotides from the start codon. As another example, two or more nuclease agents can be used, each targeting a nuclease recognition sequence including or proximate to the start codon. As another example, two nuclease agents can be used, one targeting a nuclease recognition sequence including or proximate to the start codon, and one targeting a nuclease recognition sequence including or proximate to the stop codon, wherein cleavage by the nuclease agents can result in deletion of the coding region between the two nuclease recognition sequences. Any nuclease agent that induces a nick or double-strand break into a desired recognition sequence can be used in the methods and compositions disclosed herein. Any DNA-binding protein that binds to a desired recognition sequence can be used in the methods and compositions disclosed herein.

Suitable nuclease agents and DNA-binding proteins for use herein include, but are not limited to, zinc finger protein or zinc finger nuclease (ZFN) pair, Transcription Activator-Like Effector (TALE) protein or Transcription Activator-Like Effector Nuclease (TALEN), or Clustered Regularly Interspersed Short Palindromic Repeats (CRISPR)/CRISPR-associated (Cas) systems. The length of the recognition sequence can vary, and includes, for example, recognition sequences that are about 30-36 bp for a zinc finger protein or ZFN pair, about 15-18 bp for each ZFN, about 36 bp for a TALE protein or TALEN, and about 20 bp for a CRISPR/Cas guide RNA.

In some embodiments, CRISPR/Cas systems can be used to modify a ZNRF3 genomic nucleic acid molecule within a cell. The methods and compositions disclosed herein can employ CRISPR-Cas systems by utilizing CRISPR complexes (comprising a guide RNA (gRNA) complexed with a Cas protein) for site-directed cleavage of ZNRF3 nucleic acid molecules.

Cas proteins generally comprise at least one RNA recognition or binding domain that can interact with gRNAs. Cas proteins can also comprise nuclease domains (such as, for example, DNase or RNase domains), DNA binding domains, helicase domains, protein-protein interaction domains, dimerization domains, and other domains. Suitable Cas proteins include, for example, a wild type Cas9 protein and a wild type Cpf1 protein (such as, for example, FnCpf1). A Cas protein can have full cleavage activity to create a double-strand break in a ZNRF3 genomic nucleic acid molecule or it can be a nickase that creates a single-strand break in a ZNRF3 genomic nucleic acid molecule. Additional examples of Cas proteins include, but are not limited to, Cas1, Cas1B, Cast, Cas3, Cas4, Cas5, Cas5e (CasD), Cas6, Cas6e, Cas6f, Cas7, Cas8a1, Cas8a2, Cas8b, Cas8c, Cas9 (Csn1 or Csx12), Cas10, Cas10d, CasF, CasG, CasH, Csy1, Csy2, Csy3, Cse1 (CasA), Cse2 (Cas6), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, and Cu1966, and homologs or modified versions thereof. Cas proteins can also be operably linked to heterologous polypeptides as fusion proteins. For example, a Cas protein can be fused to a cleavage domain, an epigenetic modification domain, a transcriptional activation domain, or a transcriptional repressor domain. Cas proteins can be provided in any form. For example, a Cas protein can be provided in the form of a protein, such as a Cas protein complexed with a gRNA. Alternately, a Cas protein can be provided in the form of a nucleic acid molecule encoding the Cas protein, such as an RNA or DNA.

In some embodiments, targeted genetic modifications of ZNRF3 genomic nucleic acid molecules can be generated by contacting a cell with a Cas protein and one or more gRNAs that hybridize to one or more gRNA recognition sequences within a target genomic locus in the ZNRF3 genomic nucleic acid molecule. For example, a gRNA recognition sequence can be located within a region of SEQ ID NO:1. The gRNA recognition sequence can also include or be proximate to a position corresponding to position 167,122, or position 166,500 according to SEQ ID NO:1. For example, the gRNA recognition sequence can be located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to position 167, 122, or position 166,500, according to SEQ ID NO:1. The gRNA recognition sequence can include or be proximate to the start codon of a ZNRF3 genomic nucleic acid molecule or the stop codon of a ZNRF3 genomic nucleic acid molecule. For example, the gRNA recognition sequence can be located from about 10, from about 20, from about 30, from about 40, from about 50, from about 100, from about 200, from about 300, from about 400, from about 500, or from about 1,000 nucleotides of the start codon or the stop codon.

The gRNA recognition sequences within a target genomic locus in a ZNRF3 genomic nucleic acid molecule are located near a Protospacer Adjacent Motif (PAM) sequence, which is a 2-6 base pair DNA sequence immediately following the DNA sequence targeted by the Cas9 nuclease. The canonical PAM is the sequence 5'-NGG-3' where "N" is any nucleobase followed by two guanine ("G") nucleobases. gRNAs can transport Cas9 to anywhere in the genome for gene editing, but no editing can occur at any site other than one at which Cas9 recognizes PAM. In addition, 5'-NGA-3' can be a highly efficient non-canonical PAM for human cells. Generally, the PAM is about 2-6 nucleotides downstream of the DNA sequence targeted by the gRNA. The PAM can flank the gRNA recognition sequence. In some embodiments, the gRNA recognition sequence can be flanked on the 3' end by the PAM. In some embodiments, the gRNA recognition sequence can be flanked on the 5' end by the PAM. For example, the cleavage site of Cas proteins can be about 1 to about 10, about 2 to about 5 base pairs, or three base pairs upstream or downstream of the PAM sequence. In some embodiments (such as when Cas9 from *S. pyogenes* or a closely related Cas9 is used), the PAM sequence of the non-complementary strand can be 5'-NGG-3', where N is any DNA nucleotide and is immediately 3' of the gRNA recognition sequence of the non-complementary strand of the target DNA. As such, the PAM sequence of the complementary strand would be 5'-CCN-3', where N is any DNA nucleotide and is immediately 5' of the gRNA recognition sequence of the complementary strand of the target DNA.

A gRNA is an RNA molecule that binds to a Cas protein and targets the Cas protein to a specific location within a ZNRF3 genomic nucleic acid molecule. An exemplary gRNA is a gRNA effective to direct a Cas enzyme to bind to or cleave a ZNRF3 genomic nucleic acid molecule, wherein the gRNA comprises a DNA-targeting segment that hybridizes to a gRNA recognition sequence within the ZNRF3 genomic nucleic acid molecule that includes or is proximate to a position corresponding to position 167,122, or position 166,500 according to SEQ ID NO:1. For example, a gRNA can be selected such that it hybridizes to a gRNA recognition sequence that is located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of a position corresponding to position 167,122, or position 166,500 according to SEQ ID NO:1. Other exemplary gRNAs comprise a DNA-targeting segment that hybridizes to a gRNA recognition sequence present within a ZNRF3 genomic nucleic acid molecule that includes or is proximate to the start codon or the stop codon. For example, a gRNA can be selected such that it hybridizes to a gRNA recognition sequence that is located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the start codon or located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the stop codon. Suitable gRNAs can comprise from about 17 to about 25 nucleotides, from about 17 to about 23 nucleotides, from about 18 to about 22 nucleotides, or from about 19 to about 21 nucleotides. In some embodiments, the gRNAs can comprise 20 nucleotides.

Examples of suitable gRNA recognition sequences located within the human ZNRF3 reference gene are set forth in Table 1 as SEQ ID NOS:22-39.

TABLE 1

Guide RNA Recognition Sequences Near ZNRF3 Variations

| Strand | gRNA Recognition Sequence | SEQ ID NO: |
|---|---|---|
| − | GCACCATGACTGTGCACCGCCGG | 22 |
| − | CACCATGACTGTGCACCGCCGGG | 23 |
| + | GCGGTGCACAGTCATGGTGCTGG | 24 |
| − | GTGCACCGCCGGGAGCTCCTCGG | 25 |
| + | CGGTGCACAGTCATGGTGCTGGG | 26 |
| + | CTCCCGGCGGTGCACAGTCATGG | 27 |
| + | GCACAGTCATGGTGCTGGGCGGG | 28 |
| + | CACAGTCATGGTGCTGGGCGGGG | 29 |
| + | TGCACAGTCATGGTGCTGGGCGG | 30 |
| − | CTCCGGCTGCGGTAGATGAAGGG | 31 |
| − | TGGGTCCCTTGGCAGTCCGAGGG | 32 |
| + | GCCTGCCCTCGGACTGCCAAGGG | 33 |
| − | TCCCTTGGCAGTCCGAGGGCAGG | 34 |
| − | GTGGGTCCCTTGGCAGTCCGAGG | 35 |
| + | GGCCTGCCCTCGGACTGCCAAGG | 36 |
| − | AGCCGAGGCTGTGGGTCCCTTGG | 37 |
| + | CGCGAGGCCCGGATACCCCACGG | 38 |
| + | CTCACCGAGGAACCACCGCCCGG | 39 |

The Cas protein and the gRNA form a complex, and the Cas protein cleaves the target ZNRF3 genomic nucleic acid molecule. The Cas protein can cleave the nucleic acid molecule at a site within or outside of the nucleic acid sequence present in the target ZNRF3 genomic nucleic acid molecule to which the DNA-targeting segment of a gRNA will bind. For example, formation of a CRISPR complex (comprising a gRNA hybridized to a gRNA recognition sequence and complexed with a Cas protein) can result in cleavage of one or both strands in or near (such as, for example, within 1, 2, 3, 4, 5, 6, 7, 8, 9, 10, 20, 50, or more base pairs from) the nucleic acid sequence present in the ZNRF3 genomic nucleic acid molecule to which a DNA-targeting segment of a gRNA will bind.

Such methods can result, for example, in a ZNRF3 genomic nucleic acid molecule in which a region of SEQ ID NO:1 is disrupted, the start codon is disrupted, the stop codon is disrupted, or the coding sequence is disrupted or deleted. Optionally, the cell can be further contacted with one or more additional gRNAs that hybridize to additional gRNA recognition sequences within the target genomic locus in the ZNRF3 genomic nucleic acid molecule. By contacting the cell with one or more additional gRNAs (such as, for example, a second gRNA that hybridizes to a second gRNA recognition sequence), cleavage by the Cas protein can create two or more double-strand breaks or two or more single-strand breaks.

In some embodiments, the ZNRF3 inhibitor comprises a small molecule. In some embodiments, the ZNRF3 inhibitor comprises an antibody that binds ZNRF3. Antibodies that bind to the extracellular domain of ZNRF3 include, but are not limited to sc-86958, which is an affinity purified goat polyclonal antibody raked against a peptide mapping within an internal region of ZNRF3 of human origin (Santa Cruz Biotechnology). Antibodies that bind the extracellular domain of both ZNRF3 and its murine homolog RNF43 are described in, for example, U.S. Pat. No. 9,296,826, U.S. Patent Application Publication No. US2017-0073430, and International Publication No. WO 2018/140821.

In some embodiments, the treatment methods further comprise detecting the presence or absence of a ZNRF3 predicted loss-of-function variant nucleic acid molecule encoding a human ZNRF3 polypeptide in a biological sample from the patient. As used throughout the present disclosure, a "ZNRF3 predicted loss-of-function variant nucleic acid molecule" is any ZNRF3 nucleic acid molecule (such as, for example, genomic nucleic acid molecule, mRNA molecule, or cDNA molecule) encoding a ZNRF3 polypeptide having a partial loss-of-function, a complete loss-of-function, a predicted partial loss-of-function, or a predicted complete loss-of-function.

The present disclosure also provides methods of treating a patient with a therapeutic agent that treats or inhibits decreased bone mineral density, wherein the patient is suffering from decreased bone mineral density, the method comprising the steps of: determining whether the patient has a ZNRF3 predicted loss-of-function variant nucleic acid molecule encoding a human ZNRF3 polypeptide by: obtaining or having obtained a biological sample from the patient; and performing or having performed a genotyping assay on the biological sample to determine if the patient has a genotype comprising the ZNRF3 predicted loss-of-function variant nucleic acid molecule; and when the patient is ZNRF3 reference, then administering or continuing to administer to the patient the therapeutic agent that treats or inhibits the decreased bone mineral density in a standard dosage amount, and administering to the patient a ZNRF3 inhibitor; and when the patient is heterozygous for a ZNRF3 predicted loss-of-function variant, then administering or continuing to administer to the patient the therapeutic agent that treats or inhibits the decreased bone mineral density in an amount that is the same as or lower than a standard dosage amount, and administering to the patient a ZNRF3 inhibitor; wherein the presence of a genotype having the ZNRF3 predicted loss-of-function variant nucleic acid molecule encoding the human ZNRF3 polypeptide indicates the patient has a reduced risk of developing decreased bone mineral density. In some embodiments, the patient is ZNRF3 reference. In some embodiments, the patient is heterozygous for a ZNRF3 predicted loss-of-function variant. In some embodiments, the ZNRF3 inhibitor is an anti-RNF43 antibody.

For human subjects or patients that are genotyped or determined to be either ZNRF3 reference or heterozygous for a ZNRF3 predicted loss-of-function variant, such human subjects or patients can be treated with a ZNRF3 inhibitor, as described herein.

In any of the embodiments described herein, the ZNRF3 predicted loss-of-function variant nucleic acid molecule can be any ZNRF3 nucleic acid molecule (such as, for example, genomic nucleic acid molecule, mRNA molecule, or cDNA molecule) encoding a ZNRF3 polypeptide having a partial loss-of-function, a complete loss-of-function, a predicted partial loss-of-function, or a predicted complete loss-of-function. For example, the ZNRF3 predicted loss-of-function variant nucleic acid molecule can be any nucleic acid molecule encoding ZNRF3 Ser844FS, Ser744FS, His637Arg, or His537Arg. In some embodiments, the ZNRF3 predicted loss-of-function variant nucleic acid molecule encodes ZNRF3 Ser844FS, Ser744FS, His637Arg, or His537Arg.

Detecting the presence or absence of a ZNRF3 predicted loss-of-function variant nucleic acid molecule in a biological sample from a patient and/or determining whether a patient has a ZNRF3 predicted loss-of-function variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the human subject.

In some embodiments, when the patient is ZNRF3 reference, the patient is also administered a therapeutic agent that treats or inhibits decreased bone mineral density in a standard dosage amount. In some embodiments, when the patient is heterozygous for a ZNRF3 predicted loss-of-function variant, the patient is also administered a therapeutic agent that treats or inhibits decreased bone mineral density in a dosage amount that is the same as or lower than the standard dosage amount.

In some embodiments, the treatment methods further comprise detecting the presence or absence of a ZNRF3 predicted loss-of-function polypeptide in a biological sample from the patient. In some embodiments, when the patient does not have a ZNRF3 predicted loss-of-function polypeptide, the patient is also administered a therapeutic agent that treats or inhibits decreased bone mineral density in a standard dosage amount. In some embodiments, when the patient has a ZNRF3 predicted loss-of-function polypeptide, the patient is also administered a therapeutic agent that treats or inhibits decreased bone mineral density in a dosage amount that is the same as or lower than the standard dosage amount.

The present disclosure also provides methods of treating a patient with a therapeutic agent that treats or inhibits decreased bone mineral density, wherein the patient is suffering from decreased bone mineral density, the method comprising the steps of: determining whether the patient has a ZNRF3 predicted loss-of-function polypeptide by: obtaining or having obtained a biological sample from the patient; and performing or having performed an assay on the biological sample to determine if the patient has a ZNRF3 predicted loss-of-function polypeptide; and when the patient does not have a ZNRF3 predicted loss-of-function polypeptide, then administering or continuing to administer to the patient the therapeutic agent that treats or inhibits the decreased bone mineral density in a standard dosage amount, and administering to the patient a ZNRF3 inhibitor; and when the patient has a ZNRF3 predicted loss-of-function polypeptide, then administering or continuing to administer to the patient the therapeutic agent that treats or inhibits the decreased bone mineral density in an amount that is the same as or lower than a standard dosage amount, and administering to the patient a ZNRF3 inhibitor; wherein the presence of a ZNRF3 predicted loss-of-function polypeptide indicates the patient has a reduced risk of developing the decreased bone mineral density. In some embodiments, the patient has a ZNRF3 predicted loss-of-function polypeptide. In some embodiments, the patient does not have a ZNRF3 predicted loss-of-function polypeptide.

In any of the embodiments described herein, the ZNRF3 predicted loss-of-function polypeptide can be any ZNRF3 polypeptide having a partial loss-of-function, a complete loss-of-function, a predicted partial loss-of-function, or a predicted complete loss-of-function. In any of the embodiments described herein, the ZNRF3 predicted loss-of-function polypeptide can be any of the ZNRF3 polypeptides described herein including, for example, ZNRF3 Ser844FS, Ser744FS, His637Arg, or His537Arg. In some embodiments, the ZNRF3 predicted loss-of-function polypeptide is ZNRF3 Ser844FS, Ser744FS, His637Arg, or His537Arg.

Detecting the presence or absence of a ZNRF3 predicted loss-of-function polypeptide in a biological sample from a patient and/or determining whether a patient has a ZNRF3 predicted loss-of-function polypeptide can be carried out by any of the methods described herein. In some embodiments, these methods can be carried out in vitro. In some embodiments, these methods can be carried out in situ. In some embodiments, these methods can be carried out in vivo. In any of these embodiments, the polypeptide can be present within a cell obtained from the human subject.

In any of the embodiments described herein, the decreased bone mineral density is osteopenia or osteoporosis. In any of the embodiments described herein, the decreased bone mineral density is osteopenia. In any of the embodiments described herein, the decreased bone mineral density is osteoporosis.

Examples of therapeutic agents that treat or inhibit decreased bone mineral density include, but are not limited to: calcium and vitamin D supplementation (such as, vitamin D2, vitamin D3, and cholecalciferol), bisphosphonate medications (such as, FOSAMAX® and BINOSTO® (alendronate), BONIVA® (ibandronate), RECLAST® (zoledronate), and ACTONEL® and ATELVIA® (risedronate)); MIACALCIN®, FORTICAL®, and CALCIMAR® (calcitonin); FORTEO® (teriparatide); TYMLOS® (abaloparatide); PROLIA® and XGEVA® (denosumab); EVENITY® (romosozumab-aqqg); and hormone replacement therapy with estrogen and progesterone as well as DUAVEE® (estrogen/bazodoxifene) and EVISTA® (raloxifene).

In some embodiments, the present disclosure provides combination therapies for treating decreased bone mineral density, comprising administering to the subject or patient a therapeutic agent that treats or inhibits decreased bone mineral density (such as any of the therapeutic agents described herein) and an agent that inhibits ZNRF3 (such as an anti-RNF43 antibody). In some embodiments, the present disclosure provides combination therapies for treating decreased bone mineral density, comprising administering one or more of any of the ZNRF3 inhibitors described herein and one or more of any of the anti-RNF43 antibodies described herein. In some embodiments, the anti-RNF43 antibody is administered prior to administration of the ZNRF3 inhibitor. In some embodiments, the anti-RNF43 antibody is administered after administration of the ZNRF3 inhibitor. In some embodiments, the anti-RNF43 antibody is administered with the ZNRF3 inhibitor, either in the same pharmaceutical composition or as separate compositions.

In some embodiments, the dose of the therapeutic agents that treat or inhibit decreased bone mineral density and/or inhibit ZNRF3 (such as an anti-RNF43 antibody) can be reduced by about 10%, by about 20%, by about 30%, by about 40%, by about 50%, by about 60%, by about 70%, by about 80%, or by about 90% for patients or human subjects that are heterozygous for a ZNRF3 predicted loss-of-function variant (i.e., a lower than the standard dosage amount) compared to patients or human subjects that are ZNRF3 reference (who may receive a standard dosage amount). In some embodiments, the dose of the therapeutic agents that treat or inhibit decreased bone mineral density can be reduced by about 10%, by about 20%, by about 30%, by about 40%, or by about 50%. In addition, the dose of therapeutic agents that treat or inhibit decreased bone mineral density in patients or human subjects that are heterozygous for a ZNRF3 predicted loss-of-function variant can be administered less frequently compared to patients or human subjects that are ZNRF3 reference.

Administration of the therapeutic agents that treat or inhibit decreased bone mineral density, ZNRF3 inhibitors, anti-RNF43 antibodies, or any combination thereof, can be repeated, for example, after one day, two days, three days, five days, one week, two weeks, three weeks, one month, five weeks, six weeks, seven weeks, eight weeks, two months, or three months. The repeated administration can be at the same dose or at a different dose. The administration can be repeated once, twice, three times, four times, five times, six times, seven times, eight times, nine times, ten times, or more. For example, according to certain dosage regimens a patient can receive therapy for a prolonged period of time such as, for example, 6 months, 1 year, or more.

Administration of the therapeutic agents that treat or inhibit decreased bone mineral density, ZNRF3 inhibitors, anti-RNF43 antibodies, or any combination thereof, can occur by any suitable route including, but not limited to, parenteral, intravenous, oral, subcutaneous, intra-arterial, intracranial, intrathecal, intraperitoneal, topical, intranasal, or intramuscular. Pharmaceutical compositions for administration are desirably sterile and substantially isotonic and manufactured under GMP conditions. Pharmaceutical compositions can be provided in unit dosage form (i.e., the dosage for a single administration). Pharmaceutical compositions can be formulated using one or more physiologically and pharmaceutically acceptable carriers, diluents, excipients or auxiliaries. The formulation depends on the route of administration chosen. The term "pharmaceutically acceptable" means that the carrier, diluent, excipient, or auxiliary is compatible with the other ingredients of the formulation and not substantially deleterious to the recipient thereof.

The terms "treat", "treating", and "treatment" and "prevent", "preventing", and "prevention" as used herein, refer to eliciting the desired biological response, such as a therapeutic and prophylactic effect, respectively. In some embodiments, a therapeutic effect comprises one or more of a decrease/reduction in decreased bone mineral density, a decrease/reduction in the severity of decreased bone mineral density (such as, for example, a reduction or inhibition of development or decreased bone mineral density), a decrease/reduction in symptoms and decreased bone mineral density-related effects, delaying the onset of symptoms and decreased bone mineral density-related effects, reducing the severity of symptoms of the decreased bone mineral density-related effects, reducing the severity of an acute episode, reducing the number of symptoms and decreased bone mineral density-related effects, reducing the latency of symptoms and decreased bone mineral density-related effects, an amelioration of symptoms and decreased bone mineral density-related effects, reducing secondary symptoms, reducing secondary infections, preventing relapse to decreased bone mineral density, decreasing the number or frequency of relapse episodes, increasing latency between symptomatic episodes, increasing time to sustained progression, expediting remission, inducing remission, augmenting remission, speeding recovery, or increasing efficacy of or decreasing resistance to alternative therapeutics, and/or an increased survival time of the affected host animal, following administration of the agent or composition comprising the agent. A prophylactic effect may comprise a complete or partial avoidance/inhibition or a delay of decreased bone mineral density development/progression (such as, for example, a complete or partial avoidance/inhibition or a delay), and an increased survival time of the affected host animal, following administration of a therapeutic protocol. Treatment of decreased bone mineral density encompasses the treatment of patients already diagnosed as having any form of the decreased bone mineral density at any clinical stage or manifestation, the delay of the onset or evolution or aggravation or deterioration of the symptoms or signs of decreased bone mineral density, and/or preventing and/or reducing the severity of decreased bone mineral density.

The present disclosure also provides methods of identifying a human subject having an increased risk for developing decreased bone mineral density, wherein the method comprises: determining or having determined in a biological sample obtained from the subject the presence or absence of a ZNRF3 predicted loss-of-function variant nucleic acid molecule (such as a genomic nucleic acid molecule, mRNA molecule, and/or cDNA molecule) encoding a human ZNRF3 polypeptide; wherein: i) when the human subject lacks a ZNRF3 predicted loss-of-function variant nucleic acid molecule (i.e., the human subject is genotypically categorized as a ZNRF3 reference), then the human subject has an increased risk for developing decreased bone mineral density; and ii) when the human subject has a ZNRF3 predicted loss-of-function variant nucleic acid molecule (i.e., the human subject is heterozygous for a ZNRF3 predicted loss-of-function variant or homozygous for a ZNRF3 predicted loss-of-function variant), then the human subject has a decreased risk for developing decreased bone mineral density.

Having a single copy of a ZNRF3 predicted loss-of-function variant nucleic acid molecule is more protective of a human subject from developing decreased bone mineral density than having no copies of a ZNRF3 predicted loss-of-function variant nucleic acid molecule. Without intending to be limited to any particular theory or mechanism of action, it is believed that a single copy of a ZNRF3 predicted loss-of-function variant nucleic acid molecule (i.e., heterozygous for a ZNRF3 predicted loss-of-function variant) is protective of a human subject from developing decreased bone mineral density, and it is also believed that having two copies of a ZNRF3 predicted loss-of-function variant nucleic acid molecule (i.e., homozygous for a ZNRF3 predicted loss-of-function variant) may be more protective of a human subject from developing decreased bone mineral density, relative to a human subject with a single copy. Thus, in some embodiments, a single copy of a ZNRF3 predicted loss-of-function variant nucleic acid molecule may not be completely protective, but instead, may be partially or incompletely protective of a human subject from developing decreased bone mineral density. While not desiring to be bound by any particular theory, there may be additional factors or molecules involved in the development of decreased bone mineral density that are still present in a human subject having a single copy of a ZNRF3 predicted loss-of-function variant nucleic acid molecule, thus resulting in less than complete protection from the development of decreased bone mineral density.

In any of the embodiments described herein, the ZNRF3 predicted loss-of-function variant nucleic acid molecule can be any ZNRF3 nucleic acid molecule (such as, for example, genomic nucleic acid molecule, mRNA molecule, or cDNA molecule) encoding a ZNRF3 polypeptide having a partial loss-of-function, a complete loss-of-function, a predicted partial loss-of-function, or a predicted complete loss-offunction. For example, the ZNRF3 predicted loss-of-function variant nucleic acid molecule can be any nucleic acid molecule encoding ZNRF3 Ser844FS, Ser744FS, His637Arg, or His537Arg. In some embodiments, the ZNRF3 predicted loss-of-function variant nucleic acid molecule encodes ZNRF3 Ser844FS, Ser744FS, His637Arg, or His537Arg.

Determining whether a human subject has a ZNRF3 predicted loss-of-function variant nucleic acid molecule in a biological sample from a patient and/or determining whether a patient has a ZNRF3 predicted loss-of-function variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the human subject.

In any of the embodiments described herein, the decreased bone mineral density is osteopenia or osteoporosis. In any of the embodiments described herein, the decreased bone mineral density is osteopenia. In any of the embodiments described herein, the decreased bone mineral density is osteoporosis.

In some embodiments, when a human subject is identified as having an increased risk of developing decreased bone mineral density, the human subject is further treated with a therapeutic agent that treats or inhibits decreased bone mineral density and/or a ZNRF3 inhibitor, as described herein. For example, when the human subject is ZNRF3 reference, and therefore has an increased risk for developing decreased bone mineral density, the human subject is administered a ZNRF3 inhibitor (such as an anti-RNF43 antibody). In some embodiments, such a patient is also administered a therapeutic agent that treats or inhibits decreased bone mineral density. In some embodiments, when the patient is heterozygous for a ZNRF3 predicted loss-of-function variant, the patient is administered the therapeutic agent that treats or inhibits decreased bone mineral density in a dosage amount that is the same as or lower than the standard dosage amount, and is also administered a ZNRF3 inhibitor. In some embodiments, the patient is ZNRF3 reference. In some embodiments, the patient is heterozygous for a ZNRF3 predicted loss-of-function variant.

The present disclosure also provides methods of detecting the presence or absence of a ZNRF3 predicted loss-of-function variant genomic nucleic acid molecule and/or a ZNRF3 predicted loss-of-function variant mRNA molecule in a biological sample from a human subject, and/or a ZNRF3 predicted loss-of-function variant cDNA molecule produced from an mRNA molecule in a biological sample from a human subject. Such methods can be used in any of the genotyping assays described herein. It is understood that gene sequences within a population and mRNA molecules encoded by such genes can vary due to polymorphisms such as single-nucleotide polymorphisms (SNPs). The sequences provided herein for the ZNRF3 variant genomic nucleic acid molecule, ZNRF3 variant mRNA molecule, and ZNRF3 variant cDNA molecule are only exemplary sequences. Other sequences for the ZNRF3 variant genomic nucleic acid molecule, variant mRNA molecule, and variant cDNA molecule are also possible.

The biological sample can be derived from any cell, tissue, or biological fluid from the subject. The sample may comprise any clinically relevant tissue, such as a bone marrow sample, a tumor biopsy, a fine needle aspirate, or a sample of bodily fluid, such as blood, gingival crevicular fluid, plasma, serum, lymph, ascitic fluid, cystic fluid, or urine. In some cases, the sample comprises a buccal swab. The sample used in the methods disclosed herein will vary based on the assay format, nature of the detection method, and the tissues, cells, or extracts that are used as the sample. A biological sample can be processed differently depending on the assay being employed. For example, when detecting any ZNRF3 variant nucleic acid molecule, preliminary processing designed to isolate or enrich the sample for the genomic DNA can be employed. A variety of techniques may be used for this purpose. When detecting the level of any ZNRF3 variant mRNA, different techniques can be used enrich the biological sample with mRNA. Various methods to detect the presence or level of an mRNA or the presence of a particular variant genomic DNA locus can be used.

In some embodiments, detecting a human ZNRF3 predicted loss-of-function variant nucleic acid molecule in a human subject comprises assaying or genotyping a biological sample obtained from the human subject to determine whether a ZNRF3 genomic nucleic acid molecule and/or a ZNRF3 mRNA molecule in the biological sample, and/or a ZNRF3 cDNA molecule produced from an mRNA molecule in the biological sample, comprises one or more variations that cause a loss-of-function (partial or complete) or are predicted to cause a loss-of-function (partial or complete).

In some embodiments, the methods of detecting the presence or absence of a ZNRF3 predicted loss-of-function variant nucleic acid molecule (such as, for example, a genomic nucleic acid molecule, an mRNA molecule, and/or a cDNA molecule produced from an mRNA molecule) in a human subject, comprise: performing an assay on a biological sample obtained from the human subject, which assay determines whether a nucleic acid molecule in the biological sample comprises a particular nucleotide sequence.

In some embodiments, the nucleotide sequence: lacks a position corresponding to position 167,122 according to SEQ ID NO:1 (for genomic nucleic acid molecules); lacks a position corresponding to position 2,707 according to SEQ ID NO:4, or lacks a position corresponding to position 2,397 according to SEQ ID NO:5 (for mRNA molecules); or lacks a position corresponding to position 2,707 according to SEQ ID NO:10, or lacks a position corresponding to position 2,397 according to SEQ ID NO:11 (for cDNA molecules obtained from mRNA molecules). In some embodiments where the nucleotide sequence lacks a position corresponding to position 167,122 according to SEQ ID NO:1, the nucleotide sequence comprises SEQ ID NO:2. In some embodiments where the nucleotide sequence lacks a position corresponding to position 2,707 according to SEQ ID NO:4, the nucleotide sequence comprises SEQ ID NO:6. In some embodiments where the nucleotide sequence lacks a position corresponding to position 2,397 according to SEQ ID NO:5, the nucleotide sequence comprises SEQ ID NO:7. In some embodiments where the nucleotide sequence lacks a position corresponding to position 2,707 according to SEQ ID NO:10, the nucleotide sequence comprises SEQ ID NO:12. In some embodiments where the nucleotide sequence lacks a position corresponding to position 2,397 according to SEQ ID NO:11, the nucleotide sequence comprises SEQ ID NO:13.

In some embodiments, the nucleotide sequence comprises: a guanine at a position corresponding to position 166,500 according to SEQ ID NO:3 (for genomic nucleic acid molecules); a guanine at a position corresponding to position 2,085 according to SEQ ID NO:8, or a guanine at a position corresponding to position 1,175 according to SEQ ID NO:9 (for mRNA molecules); or a guanine at a position corresponding to position 2,085 according to SEQ ID NO:14, or a guanine at a position corresponding to position 1,175 according to SEQ ID NO:15 (for cDNA molecules obtained from mRNA molecules).

In some embodiments, the biological sample comprises a cell or cell lysate. Such methods can further comprise, for example, obtaining a biological sample from the subject comprising a ZNRF3 genomic nucleic acid molecule or mRNA molecule, and if mRNA, optionally reverse transcribing the mRNA into cDNA. Such assays can comprise, for example determining the identity of these positions of the particular ZNRF3 nucleic acid molecule. In some embodiments, the method is an in vitro method.

In some embodiments, the determining step, detecting step, or genotyping assay comprises sequencing at least a portion of the nucleotide sequence of the ZNRF3 genomic nucleic acid molecule, the ZNRF3 mRNA molecule, or the ZNRF3 cDNA molecule in the biological sample, wherein the sequenced portion comprises one or more variations that cause a loss-of-function (partial or complete) or are predicted to cause a loss-of-function (partial or complete).

In some embodiments, the determining step, detecting step, or genotyping assay comprises sequencing at least a portion of: the nucleotide sequence of the ZNRF3 genomic nucleic acid molecule in the biological sample, wherein the sequenced portion comprises a position corresponding to position 167,122 according to SEQ ID NO:2, or any position 3' thereto, or the complement thereof; the nucleotide sequence of the ZNRF3 mRNA molecule in the biological sample, wherein the sequenced portion comprises a position corresponding to position 2,707 according to SEQ ID NO:6, or any position 3' thereto, or the complement thereof, or wherein the sequenced portion comprises a position corresponding to position 2,397 according to SEQ ID NO:7, or any position 3' thereto, or the complement thereof; and/or the nucleotide sequence of the ZNRF3 cDNA molecule produced from the mRNA in the biological sample, wherein the sequenced portion comprises a position corresponding to position 2,707 according to SEQ ID NO:12, or any position 3' thereto, or the complement thereof, or wherein the sequenced portion comprises a position corresponding to position 2,397 according to SEQ ID NO:13, or any position 3' thereto, or the complement thereof. In embodiments whereby the sequenced portion comprises any position that is 3' to the stated position, the nucleotide in the queried position that is 3' to the stated position is a nucleotide within the corresponding position of the corresponding reference nucleic acid molecule that is shifted one base to the 5' direction. For example, when the sequenced portion comprises a position corresponding to position 167,130 according to SEQ ID NO:2, the nucleotide in position 167,130 will be the same nucleotide that is in position 167,131 according to SEQ ID NO:1. When the sequenced portion of the ZNRF3 nucleic acid molecule in the biological sample: lacks a position corresponding to position 167,122 according to SEQ ID NO:1, lacks a position corresponding to position 2,707 according to SEQ ID NO:4, lacks a position corresponding to position 2,397 according to SEQ ID NO:5, lacks a position corresponding to position 2,707 according to SEQ ID NO:10, or lacks a position corresponding to position 2,397 according to SEQ ID NO:11, then the ZNRF3 nucleic acid molecule in the biological sample is a ZNRF3 predicted loss-of-function variant nucleic acid molecule. In some embodiments where the ZNRF3 nucleic acid molecule in the biological sample lacks a position corresponding to position 167,122 according to SEQ ID NO:1, the nucleotide sequence comprises SEQ ID NO:2. In some embodiments where the ZNRF3 nucleic acid molecule in the biological sample lacks a position corresponding to position 2,707 according to SEQ ID NO:4, the nucleotide sequence comprises SEQ ID NO:6. In some embodiments where the ZNRF3 nucleic acid molecule in the biological sample lacks a position corresponding to position 2,397 according to SEQ ID NO:5, the nucleotide sequence comprises SEQ ID NO:7. In some embodiments where the ZNRF3 nucleic acid molecule in the biological sample lacks a position corresponding to position 2,707 according to SEQ ID NO:10, the nucleotide sequence comprises SEQ ID NO:12. In some embodiments where the ZNRF3 nucleic acid molecule in the biological sample lacks a position corresponding to position 2,397 according to SEQ ID NO:11, the nucleotide sequence comprises SEQ ID NO:13.

In some embodiments, the determining step, detecting step, or genotyping assay comprises sequencing at least a portion of: the nucleotide sequence of the ZNRF3 genomic nucleic acid molecule in the biological sample, wherein the sequenced portion comprises a position corresponding to position 166,500 according to SEQ ID NO:3, or the complement thereof; the nucleotide sequence of the ZNRF3 mRNA molecule in the biological sample, wherein the sequenced portion comprises a position corresponding to position 2,085 according to SEQ ID NO:8, or wherein the sequenced portion comprises a position corresponding to position 1,775 according to SEQ ID NO:9, or the complement thereof; and/or the nucleotide sequence of the ZNRF3 cDNA molecule produced from the mRNA in the biological sample, wherein the sequenced portion comprises a position corresponding to position 2,085 according to SEQ ID NO:14, or wherein the sequenced portion comprises a position corresponding to position 1,775 according to SEQ ID NO:15, or the complement thereof. When the sequenced portion of the ZNRF3 nucleic acid molecule in the biological sample comprises: a guanine at a position corresponding to position 166,500 according to SEQ ID NO:3, a guanine at a position corresponding to position 2,085 according to SEQ ID NO:8, a guanine at a position corresponding to position 1,175 according to SEQ ID NO:9, a guanine at a position corresponding to position 2,085 according to SEQ ID NO:14, or a guanine at a position corresponding to position 1,175 according to SEQ ID NO:15, then the ZNRF3 nucleic acid molecule in the biological sample is a ZNRF3 predicted loss-of-function variant nucleic acid molecule.

In some embodiments, the determining step, detecting step, or genotyping assay comprises: a) contacting the biological sample with a primer hybridizing to a portion of the nucleotide sequence of: the ZNRF3 genomic nucleic acid molecule that is proximate to a position corresponding to position 167,122 according to SEQ ID NO:2; the ZNRF3 mRNA molecule that is proximate to a position corresponding to position 2,707 according to SEQ ID NO:6, or that is proximate to a position corresponding to position 2,397 according to SEQ ID NO:7; and/or the ZNRF3 cDNA molecule that is proximate to a position corresponding to position 2,707 according to SEQ ID NO:12, or that is proximate to a position corresponding to position 2,397 according to SEQ ID NO:13; b) extending the primer at least through the position of the nucleotide sequence of: the ZNRF3 genomic nucleic acid molecule corresponding to position 167,123 according to SEQ ID NO:2; the ZNRF3 mRNA molecule corresponding to position 2,708 according to SEQ ID NO:6, or corresponding to position 2,398 according to SEQ ID NO:7; and/or the ZNRF3 cDNA molecule corresponding to position 2,708 according to SEQ ID NO:12, or corresponding to position 2,398 according to SEQ ID NO:13; and c) determining whether the extension product of the primer: lacks a position corresponding to position 167,122 according to SEQ ID NO:1; lacks a position corresponding to position 2,707 according to SEQ ID NO:4, or lacks a position corresponding to position 2,397 according to SEQ ID NO:5; and/or lacks a position corresponding to position 2,707 according to SEQ ID NO:10, or lacks a position corresponding to position 2,397 according to SEQ ID NO:11. In some embodiments where the extension product of the primer lacks a position corresponding to position 167,122 according to SEQ ID NO:1, the nucleotide sequence comprises SEQ ID NO:2. In some embodiments where the extension product of the primer lacks a position corresponding to position 2,707 according to SEQ ID NO:4, the nucleotide sequence comprises SEQ ID NO:6. In some embodiments where the extension product of the primer lacks a position corresponding to position 2,397 according to SEQ ID NO:5, the nucleotide sequence comprises SEQ ID NO:7. In some embodiments where the extension product of the primer lacks a position corresponding to position 2,707 according to SEQ ID NO:10, the nucleotide sequence comprises SEQ ID NO:12. In some embodiments where the extension product of the primer lacks a position corresponding to position 2,397 according to SEQ ID NO:11, the nucleotide sequence comprises SEQ ID NO:13.

In some embodiments, the determining step, detecting step, or genotyping assay comprises: a) contacting the biological sample with a primer hybridizing to a portion of the nucleotide sequence of: the ZNRF3 genomic nucleic acid molecule that is proximate to a position corresponding to position 166,500 according to SEQ ID NO:3; the ZNRF3 mRNA molecule that is proximate to a position corresponding to position 2,085 according to SEQ ID NO:8, or proximate to a position corresponding to position 1,775 according to SEQ ID NO:9; and/or the ZNRF3 cDNA molecule that is proximate to a position corresponding to position 2,085 according to SEQ ID NO:14, or proximate to a position corresponding to position 1,775 according to SEQ ID NO:15; b) extending the primer at least through the position of the nucleotide sequence of: the ZNRF3 genomic nucleic acid molecule corresponding to position 166,500 according to SEQ ID NO:3; the ZNRF3 mRNA molecule corresponding to position 2,085 according to SEQ ID NO:8, or corresponding to position 1,775 according to SEQ ID NO:9; and/or the ZNRF3 cDNA molecule corresponding to position 2,085 according to SEQ ID NO:14, or corresponding to position 1,775 according to SEQ ID NO:15; and c) determining whether the extension product of the primer comprises: a guanine at a position corresponding to position 166,500 according to SEQ ID NO:3; a guanine at a position corresponding to position 2,085 according to SEQ ID NO:8, or a guanine at a position corresponding to position 1,175 according to SEQ ID NO:9; and/or a guanine at a position corresponding to position 2,085 according to SEQ ID NO:14, or a guanine at a position corresponding to position 1,175 according to SEQ ID NO:15.

In some embodiments, the assay comprises sequencing the entire nucleic acid molecule. In some embodiments, only a ZNRF3 genomic nucleic acid molecule is analyzed. In some embodiments, only a ZNRF3 mRNA is analyzed. In some embodiments, only a ZNRF3 cDNA obtained from ZNRF3 mRNA is analyzed.

In some embodiments, the determining step, detecting step, or genotyping assay comprises: a) amplifying at least a portion of the nucleic acid molecule that encodes the human ZNRF3 polypeptide, wherein the amplified portion: lacks a position corresponding to position 167,122 according to SEQ ID NO:1, or the complement thereof; lacks a position corresponding to position 2,707 according to SEQ ID NO:4, or lacks a position corresponding to position 2,397 according to SEQ ID NO:5, or the complement thereof; and/or lacks a position corresponding to position 2,707 according to SEQ ID NO:10, or lacks a position corresponding to position 2,397 according to SEQ ID NO:11, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacks a position corresponding to position 167,122 according to SEQ ID NO:1, or the complement thereof; lacks a position corresponding to position 2,707 according to SEQ ID NO:4, or lacks a position corresponding to position 2,397 according to SEQ ID NO:5, or the complement thereof; and/or lacks a position corresponding to position 2,707 according to SEQ ID NO:10, or lacks a position corresponding to position 2,397 according to SEQ ID NO:11, or the complement thereof; and d) detecting the detectable label. In some embodiments where the nucleic acid sequence of the amplified nucleic acid molecule lacks a position corresponding to position 167,122 according to SEQ ID NO:1, the nucleotide sequence comprises SEQ ID NO:2. In some embodiments where the nucleic acid sequence of the amplified nucleic acid molecule lacks a position corresponding to position 2,707 according to SEQ ID NO:4, the nucleotide sequence comprises SEQ ID NO:6. In some embodiments where the nucleic acid sequence of the amplified nucleic acid molecule lacks a position corresponding to position 2,397 according to SEQ ID NO:5, the nucleotide sequence comprises SEQ ID NO:7. In some embodiments where the nucleic acid sequence of the amplified nucleic acid molecule lacks a position corresponding to position 2,707 according to SEQ ID NO:10, the nucleotide sequence comprises SEQ ID NO:12. In some embodiments where the nucleic acid sequence of the amplified nucleic acid molecule lacks a position corresponding to position 2,397 according to SEQ ID NO:11, the nucleotide sequence comprises SEQ ID NO:13.

In some embodiments, the determining step, detecting step, or genotyping assay comprises: a) amplifying at least a portion of the nucleic acid molecule that encodes the human ZNRF3 polypeptide, wherein the amplified portion comprises: a guanine at a position corresponding to position 166,500 according to SEQ ID NO:3, or the complement thereof; a guanine at a position corresponding to position 2,085 according to SEQ ID NO:8, or a guanine at a position corresponding to position 1,175 according to SEQ ID NO:9, or the complement thereof; and/or a guanine at a position corresponding to position 2,085 according to SEQ ID NO:14, or a guanine at a position corresponding to position 1,175 according to SEQ ID NO:15, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: a guanine at a position corresponding to position 166,500 according to SEQ ID NO:3, or the complement thereof; a guanine at a position corresponding to position 2,085 according to SEQ ID NO:8, or a guanine at a position corresponding to position 1,175 according to SEQ ID NO:9, or the complement thereof; and/or a guanine at a position corresponding to position 2,085 according to SEQ ID NO:14, or a guanine at a position corresponding to position 1,175 according to SEQ ID NO:15, or the complement thereof; and d) detecting the detectable label.

In some embodiments, the nucleic acid molecule is mRNA and the determining step further comprises reverse-transcribing the mRNA into a cDNA prior to the amplifying step.

In some embodiments, the determining step, detecting step, or genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a deletion of the position (guanine) corresponding to position 167,122 according to SEQ ID NO:1, or the complement thereof; a deletion of the position (guanine) corresponding to position 2,707 according to SEQ ID NO:4, a deletion of the position (guanine) corresponding to position 2,397 according to SEQ ID NO:5, or the complement thereof; and/or a deletion of the position (guanine) corresponding to position 2,707 according to SEQ ID NO:10, or deletion of the position (guanine) corresponding to position 2,397 according to SEQ ID NO:11, or the complement thereof; and detecting the detectable label. In some embodiments where the nucleotide sequence of the amplified nucleic acid molecule lacks a position corresponding to position 167,122 according to SEQ ID NO:1, the nucleotide sequence comprises SEQ ID NO:2. In some embodiments where the nucleotide sequence of the amplified nucleic acid molecule lacks a position corresponding to position 2,707 according to SEQ ID NO:4, the nucleotide sequence comprises SEQ ID NO:6. In some embodiments where the nucleotide sequence of the amplified nucleic acid molecule lacks a position corresponding to position 2,397 according to SEQ ID NO:5, the nucleotide sequence comprises SEQ ID NO:7. In some embodiments where the nucleotide sequence of the amplified nucleic acid molecule lacks a position corresponding to position 2,707 according to SEQ ID NO:10, the nucleotide sequence comprises SEQ ID NO:12. In some embodiments where the nucleotide sequence of the amplified nucleic acid molecule lacks a position corresponding to position 2,397 according to SEQ ID NO:11, the nucleotide sequence comprises SEQ ID NO:13.

In some embodiments, the determining step, detecting step, or genotyping assay comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: a guanine at a position corresponding to position 166,500 according to SEQ ID NO:3, or the complement thereof; a guanine at a position corresponding to position 2,085 according to SEQ ID NO:8, or a guanine at a position corresponding to position 1,175 according to SEQ ID NO:9, or the complement thereof; and/or a guanine at a position corresponding to position 2,085 according to SEQ ID NO:14, or a guanine at a position corresponding to position 1,175 according to SEQ ID NO:15, or the complement thereof; and detecting the detectable label.

Alteration-specific polymerase chain reaction techniques can be used to detect mutations such as SNPs in a nucleic acid sequence. Alteration-specific primers can be used because the DNA polymerase will not extend when a mismatch with the template is present.

In some embodiments, the nucleic acid molecule in the sample is mRNA and the mRNA is reverse-transcribed into a cDNA prior to the amplifying step. In some embodiments, the nucleic acid molecule is present within a cell obtained from the human subject.

The ZNRF3 predicted loss-of-function variant nucleic acid molecule can be any ZNRF3 nucleic acid molecule (such as, for example, genomic nucleic acid molecule, mRNA molecule, or cDNA molecule) encoding a ZNRF3 polypeptide having a partial loss-of-function, a complete loss-of-function, a predicted partial loss-of-function, or a predicted complete loss-of-function. For example, the ZNRF3 predicted loss-of-function variant nucleic acid molecule can be any nucleic acid molecule encoding ZNRF3 Ser844FS, Ser744FS, His637Arg, or His537Arg. In some embodiments, the ZNRF3 predicted loss-of-function variant nucleic acid molecule encodes ZNRF3 Ser844FS, Ser744FS, His637Arg, or His537Arg.

In some embodiments, the assay comprises contacting the biological sample with a primer or probe, such as an alteration-specific primer or alteration-specific probe, that specifically hybridizes to a ZNRF3 variant genomic sequence, variant mRNA sequence, or variant cDNA sequence and not the corresponding ZNRF3 reference sequence under stringent conditions, and determining whether hybridization has occurred.

In some embodiments, the assay comprises RNA sequencing (RNA-Seq). In some embodiments, the assays also comprise reverse transcribing mRNA into cDNA, such as by the reverse transcriptase polymerase chain reaction (RT-PCR).

In some embodiments, the methods utilize probes and primers of sufficient nucleotide length to bind to the target nucleotide sequence and specifically detect and/or identify a polynucleotide comprising a ZNRF3 variant genomic nucleic acid molecule, variant mRNA molecule, or variant cDNA molecule. The hybridization conditions or reaction conditions can be determined by the operator to achieve this result. The nucleotide length may be any length that is sufficient for use in a detection method of choice, including any assay described or exemplified herein. Such probes and primers can hybridize specifically to a target nucleotide sequence under high stringency hybridization conditions. Probes and primers may have complete nucleotide sequence identity of contiguous nucleotides within the target nucleotide sequence, although probes differing from the target nucleotide sequence and that retain the ability to specifically detect and/or identify a target nucleotide sequence may be designed by conventional methods. Probes and primers can have about 80%, about 85%, about 90%, about 91%, about 92%, about 93%, about 94%, about 95%, about 96%, about 97%, about 98%, about 99%, or 100% sequence identity or complementarity with the nucleotide sequence of the target nucleic acid molecule.

In some embodiments, to determine whether a ZNRF3 nucleic acid molecule (genomic nucleic acid molecule, mRNA molecule, or cDNA molecule), or complement thereof, within a biological sample comprises a nucleotide sequence comprising a deletion of the position (guanine) corresponding to position 167,122 according to SEQ ID NO:1 (genomic nucleic acid molecule) (such as comprising SEQ ID NO:2), or a deletion of the position (guanine) corresponding to position 2,707 according to SEQ ID NO:4 (such as comprising SEQ ID NO:6), or a deletion of the position (guanine) corresponding to position 2,397 according to SEQ ID NO:5 (such as comprising SEQ ID NO:7) (mRNA molecule), or a deletion of the position (guanine) corresponding to position 2,707 according to SEQ ID NO:10 (such as comprising SEQ ID NO:12), or a deletion of the position (guanine) corresponding to position 2,397 according to SEQ ID NO:11 (such as comprising SEQ ID NO:13) (cDNA molecule), the biological sample can be subjected to an amplification method using a primer pair that includes a first primer derived from the 5' flanking sequence adjacent to a deletion of the position (guanine) corresponding to position 167,122 according to SEQ ID NO:1 (such as comprising SEQ ID NO:2), or a deletion of the position (guanine) corresponding to position 2,707 according to SEQ ID NO:4 (such as comprising SEQ ID NO:6), or a deletion of the position (guanine) corresponding to position 2,397 according to SEQ ID NO:5 (such as comprising SEQ ID NO:7), or a deletion of the position (guanine) corresponding to position 2,707 according to SEQ ID NO:10 (such as comprising SEQ ID NO:12), or a deletion of the position (guanine) corresponding to position 2,397 according to SEQ ID NO:11 (such as comprising SEQ ID NO:13), and a second primer derived from the 3' flanking sequence adjacent to a deletion of the position (guanine) corresponding to position 167,122 according to SEQ ID NO:1 (such as comprising SEQ ID NO:2), or a deletion of the position (guanine) corresponding to position 2,707 according to SEQ ID NO:4 (such as comprising SEQ ID NO:6), or a deletion of the position (guanine) corresponding to position 2,397 according to SEQ ID NO:5 (such as comprising SEQ ID NO:7), or a deletion of the position (guanine) corresponding to position 2,707 according to SEQ ID NO:10 (such as comprising SEQ ID NO:12), or a deletion of the position (guanine) corresponding to position 2,397 according to SEQ ID NO:11 (such as comprising SEQ ID NO:13), to produce an amplicon that is indicative of the absence of a position (guanine) corresponding to position 167,122 according to SEQ ID NO:1 (such as comprising SEQ ID NO:2), or the absence of a position (guanine) corresponding to position 2,707 according to SEQ ID NO:4 (such as comprising SEQ ID NO:6), or the absence of a position (guanine) corresponding to position 2,397 according to SEQ ID NO:5 (such as comprising SEQ ID NO:7), or the absence of a position (guanine) corresponding to position 2,707 according to SEQ ID NO:10 (such as comprising SEQ ID NO:12), or the absence of a position (guanine) corresponding to position 2,397 according to SEQ ID NO:11 (such as comprising SEQ ID NO:13). In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising a deletion of the position (guanine) corresponding to position 167,122 according to SEQ ID NO:1 (such as comprising SEQ ID NO:2), or a deletion of the position (guanine) corresponding to position 2,707 according to SEQ ID NO:4 (such as comprising SEQ ID NO:6), or a deletion of the position (guanine) corresponding to position 2,397 according to SEQ ID NO:5 (such as comprising SEQ ID NO:7), or a deletion of the position (guanine) corresponding to position 2,707 according to SEQ ID NO:10 (such as comprising SEQ ID NO:12), or deletion of the position (guanine) corresponding to position 2,397 according to SEQ ID NO:11 (such as comprising SEQ ID NO:13), and at least 1, 2, 3, 4, 5, 6, 7, 8, 9, 10, or more nucleotides on each side of positions comprising a deletion of the position (guanine) corresponding to position 167,122 according to SEQ ID NO:1 (such as comprising SEQ ID NO:2), or a deletion of the position (guanine) corresponding to position 2,707 according to SEQ ID NO:4 (such as comprising SEQ ID NO:6), or a deletion of the position (guanine) corresponding to position 2,397 according to SEQ ID NO:5 (such as comprising SEQ ID NO:7), a deletion of the position (guanine) corresponding to position 2,707 according to SEQ ID NO:10 (such as comprising SEQ ID NO:12), or a deletion of the position (guanine) corresponding to position 2,397 according to SEQ ID NO:11 (such as comprising SEQ ID NO:13).

In some embodiments, to determine whether a ZNRF3 nucleic acid molecule (genomic nucleic acid molecule, mRNA molecule, or cDNA molecule), or complement thereof, within a biological sample comprises a nucleotide sequence comprising a guanine at a position corresponding to position 166,500 according to SEQ ID NO:3 (genomic nucleic acid molecule), or a guanine at a position corresponding to position 2,085 according to SEQ ID NO:8, or a guanine at a position corresponding to position 1,175 according to SEQ ID NO:9 (mRNA molecule), or a guanine at a position corresponding to position 2,085 according to SEQ ID NO:14, or a guanine at a position corresponding to position 1,175 according to SEQ ID NO:15 (cDNA molecule), the biological sample can be subjected to an amplification method using a primer pair that includes a first primer derived from the 5' flanking sequence adjacent to a guanine at a position corresponding to position 166,500 according to SEQ ID NO:3, or a guanine at a position corresponding to position 2,085 according to SEQ ID NO:8, or a guanine at a position corresponding to position 1,175 according to SEQ ID NO:9, a guanine at a position corresponding to position 2,085 according to SEQ ID NO:14, or a guanine at a position corresponding to position 1,175 according to SEQ ID NO:15, and a second primer derived from the 3' flanking sequence adjacent to a guanine at a position corresponding to position 166,500 according to SEQ ID NO:3, a guanine at a position corresponding to position 2,085 according to SEQ ID NO:8, a guanine at a position corresponding to positions 1,175 according to SEQ ID NO:9, a guanine at a position corresponding to position 2,085 according to SEQ ID NO:14, or a guanine at a position corresponding to position 1,175 according to SEQ ID NO:15, to produce an amplicon that is indicative of the presence of a guanine at a position corresponding to position 166,500 according to SEQ ID NO:3, a guanine at a position corresponding to position 2,085 according to SEQ ID NO:8, a guanine at a position corresponding to position 1,175 according to SEQ ID NO:9, a guanine at a position corresponding to position 2,085 according to SEQ ID NO:14, or a guanine at a position corresponding to position 1,175 according to SEQ ID NO:15. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising a guanine at a position corresponding to position 166,500 according to SEQ ID NO:3, a guanine at a position corresponding to position 2,085 according to SEQ ID NO:8, a guanine at a position corresponding to position 1,175 according to SEQ ID NO:9, a guanine at a position corresponding to position 2,085 according to SEQ ID NO:14, or a guanine at a position corresponding to position 1,175 according to SEQ ID NO:15, and at least 1, 2, 3, 4, 5, 6, 7, 8, 9, 10, or more nucleotides on each side of positions comprising a guanine at a position corresponding to position 166,500 according to SEQ ID NO:3, a guanine at a position corresponding to position 2,085 according to SEQ ID NO:8, a guanine at a position corresponding to position 1,175 according to SEQ ID NO:9, a guanine at a position corresponding to position 2,085 according to SEQ ID NO:14, or a guanine at a position corresponding to position 1,175 according to SEQ ID NO:15.

Similar amplicons can be generated from the mRNA and/or cDNA sequences. PCR primer pairs can be derived from a known sequence, for example, by using computer programs intended for that purpose, such as the PCR primer analysis tool in Vector NTI version 10 (Informax Inc., Bethesda Md.); PrimerSelect (DNASTAR Inc., Madison, Wis.); and Primer3 (Version 0.4.0.COPYRGT., 1991, Whitehead Institute for Biomedical Research, Cambridge, Mass.). Additionally, the sequence can be visually scanned and primers manually identified using known guidelines.

Illustrative examples of nucleic acid sequencing techniques include, but are not limited to, chain terminator (Sanger) sequencing and dye terminator sequencing. Other methods involve nucleic acid hybridization methods other than sequencing, including using labeled primers or probes directed against purified DNA, amplified DNA, and fixed cell preparations (fluorescence in situ hybridization (FISH)). In some methods, a target nucleic acid molecule may be amplified prior to or simultaneously with detection. Illustrative examples of nucleic acid amplification techniques include, but are not limited to, polymerase chain reaction (PCR), ligase chain reaction (LCR), strand displacement amplification (SDA), and nucleic acid sequence based amplification (NASBA). Other methods include, but are not limited to, ligase chain reaction, strand displacement amplification, and thermophilic SDA (tSDA).

In hybridization techniques, stringent conditions can be employed such that a probe or primer will specifically hybridize to its target. In some embodiments, a polynucleotide primer or probe under stringent conditions will hybridize to its target sequence to a detectably greater degree than to other non-target sequences, such as, at least 2-fold, at least 3-fold, at least 4-fold, or more over background, including over 10-fold over background. In some embodiments, a polynucleotide primer or probe under stringent conditions will hybridize to its target nucleotide sequence to a detectably greater degree than to other nucleotide sequences by at least 2-fold. In some embodiments, a polynucleotide primer or probe under stringent conditions will hybridize to its target nucleotide sequence to a detectably greater degree than to other nucleotide sequences by at least 3-fold. In some embodiments, a polynucleotide primer or probe under stringent conditions will hybridize to its target nucleotide sequence to a detectably greater degree than to other nucleotide sequences by at least 4-fold. In some embodiments, a polynucleotide primer or probe under stringent conditions will hybridize to its target nucleotide sequence to a detectably greater degree than to other nucleotide sequences by over 10-fold over background. Stringent conditions are sequence-dependent and will be different in different circumstances.

Appropriate stringency conditions which promote DNA hybridization, for example, 6× sodium chloride/sodium citrate (SSC) at about 45° C., followed by a wash of 2×SSC at 50° C., are known or can be found in Current Protocols in Molecular Biology, John Wiley & Sons, N.Y. (1989), 6.3.1-6.3.6. Typically, stringent conditions for hybridization and detection will be those in which the salt concentration is less than about 1.5 M $Na^+$ ion, typically about 0.01 to 1.0 M $Na^+$ ion concentration (or other salts) at pH 7.0 to 8.3 and the temperature is at least about 30° C. for short probes (such as, for example, 10 to 50 nucleotides) and at least about 60° C. for longer probes (such as, for example, greater than 50 nucleotides). Stringent conditions may also be achieved with the addition of destabilizing agents such as formamide. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

The present disclosure also provides methods of detecting the presence of a human ZNRF3 predicted loss-of-function polypeptide comprising performing an assay on a sample obtained from a human subject to determine whether a ZNRF3 polypeptide in the subject contains one or more variations that causes the polypeptide to have a loss-of-function (partial or complete) or predicted loss-of-function (partial or complete). The ZNRF3 predicted loss-of-function polypeptide can be any of the ZNRF3 truncated variant polypeptides described herein. In some embodiments, the methods detect the presence of ZNRF3 Ser844FS, Ser744FS, His637Arg, or His537Arg. In some embodiments, the methods detect the presence of ZNRF3 Ser844FS, Ser744FS, His637Arg, or His537Arg.

In some embodiments, the methods comprise performing an assay on a sample obtained from a human subject to determine whether a ZNRF3 polypeptide in the sample comprises a serine at a position corresponding to position 844 according to SEQ ID NO:18, or comprises a serine at a position corresponding to position 744 according to SEQ ID NO:19. In some embodiments, the methods comprise performing an assay on a sample obtained from a human subject to determine whether a ZNRF3 polypeptide in the sample comprises a sequence according to SEQ ID NO:18 or SEQ ID NO:19. In some embodiments, the methods comprise performing an assay on a sample obtained from a human subject to determine whether a ZNRF3 polypeptide in the sample comprises an arginine at a position corresponding to position 637 according to SEQ ID NO:20, or comprises an arginine at a position corresponding to position 537 according to SEQ ID NO:21. In some embodiments, the methods comprise performing an assay on a sample obtained from a human subject to determine whether a ZNRF3 polypeptide in the sample comprises a sequence according to SEQ ID NO:20 or SEQ ID NO:21.

In some embodiments, the detecting step comprises sequencing at least a portion of the polypeptide that comprises a position corresponding to position 844 according to SEQ ID:16 or SEQ ID NO:18, and/or a position corresponding to position 744 according to SEQ ID:17 or SEQ ID NO:19. In some embodiments, the detecting step comprises sequencing at least a portion of the polypeptide that comprises a position corresponding to position 637 according to SEQ ID:16 or SEQ ID NO:20, and/or a position corresponding to position 537 according to SEQ ID:17 or SEQ ID NO:21.

In some embodiments, the detecting step comprises an immunoassay for detecting the presence of a polypeptide that comprises a position corresponding to position 844 according to SEQ ID:16 or SEQ ID NO:18, and/or a position corresponding to position 744 according to SEQ ID:17 or SEQ ID NO:19. In some embodiments, the detecting step comprises an immunoassay for detecting the presence of a polypeptide that comprises a position corresponding to position 637 according to SEQ ID:16 or SEQ ID NO:20, and/or a position corresponding to position 537 according to SEQ ID:17 or SEQ ID NO:21.

In some embodiments, when the human subject does not have a ZNRF3 predicted loss-of-function polypeptide, then the human subject has an increased risk for developing decreased bone mineral density; and when the human subject has a ZNRF3 predicted loss-of-function polypeptide, then the human subject has a decreased risk for developing decreased bone mineral density.

The present disclosure also provides isolated nucleic acid molecules that hybridize to ZNRF3 variant genomic nucleic acid molecules, ZNRF3 variant mRNA molecules, and/or ZNRF3 variant cDNA molecules (such as any of the genomic variant nucleic acid molecules, mRNA variant molecules, and cDNA variant molecules disclosed herein). In some embodiments, the isolated nucleic acid molecules hybridize to a portion of the ZNRF3 nucleic acid molecule that includes: a position corresponding to position 167,123 according to SEQ ID NO:2; a position corresponding to position 2,708 according to SEQ ID NO:6; a position corresponding to position 2,398 according to SEQ ID NO:7; a position corresponding to position 2,708 according to SEQ ID NO:12; or a position corresponding to positions 2,398 according to SEQ ID NO:13. In some embodiments, the isolated nucleic acid molecules hybridize to a portion of the ZNRF3 nucleic acid molecule that includes: a position corresponding to position 166,500 according to SEQ ID NO:3; a position corresponding to position 2,085 according to SEQ ID NO:8; a position corresponding to position 1,775 according to SEQ ID NO:9; a position corresponding to position 2,085 according to SEQ ID NO:14; or a position corresponding to position 1,775 according to SEQ ID NO:15.

In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, at least about 100, at least about 200, at least about 300, at least about 400, at least about 500, at least about 600, at least about 700, at least about 800, at least about 900, at least about 1000, at least about 2000, at least about 3000, at least about 4000, or at least about 5000 nucleotides. In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, or at least about 25 nucleotides. In some embodiments, the isolated nucleic acid molecules comprise or consist of at least about 18 nucleotides. In some embodiments, the isolated nucleic acid molecules comprise or consists of at least about 15 nucleotides. In some embodiments, the isolated nucleic acid molecules consist of or comprise from about 10 to about 35, from about 10 to about 30, from about 10 to about 25, from about 12 to about 30, from about 12 to about 28, from about 12 to about 24, from about 15 to about 30, from about 15 to about 25, from about 18 to about 30, from about 18 to about 25, from about 18 to about 24, or from about 18 to about 22 nucleotides. In some embodiments, the isolated nucleic acid molecules consist of or comprise from about 18 to about 30 nucleotides. In some embodiments, the isolated nucleic acid molecules comprise or consist of at least about 15 nucleotides to at least about 35 nucleotides.

In some embodiments, such isolated nucleic acid molecules hybridize to ZNRF3 variant nucleic acid molecules (such as genomic nucleic acid molecules, mRNA molecules, and/or cDNA molecules) under stringent conditions. Such nucleic acid molecules can be used, for example, as probes, primers, alteration-specific probes, or alteration-specific primers as described or exemplified herein, and include, without limitation primers, probes, antisense RNAs, shRNAs, and siRNAs, each of which is described in more detail elsewhere herein, and can be used in any of the methods described herein.

In some embodiments, the isolated nucleic acid molecules hybridize to at least about 15 contiguous nucleotides of a nucleic acid molecule that is at least about 70%, at least about 75%, at least about 80%, at least about 85%, at least about 90%, at least about 95%, at least about 96%, at least about 97%, at least about 98%, at least about 99%, or 100% identical to ZNRF3 variant genomic nucleic acid molecules, ZNRF3 variant mRNA molecules, and/or ZNRF3 variant cDNA molecules. In some embodiments, the isolated nucleic acid molecules consist of or comprise from about 15 to about 100 nucleotides, or from about 15 to about 35 nucleotides. In some embodiments, the isolated nucleic acid molecules consist of or comprise from about 15 to about 100 nucleotides. In some embodiments, the isolated nucleic acid molecules consist of or comprise from about 15 to about 35 nucleotides.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human ZNRF3 polypeptide, wherein the portion comprises a position corresponding to: position 167,123 according to SEQ ID NO:2, or the complement thereof; position 2,708 according to SEQ ID NO:6, or the complement thereof; position 2,398 according to SEQ ID NO:7, or the complement thereof; position 2,708 according to SEQ ID NO:12, or the complement thereof; or position 2,398 according to SEQ ID NO:13, or the complement thereof. In some embodiments, the alteration-specific probe or alteration-specific primer comprises a nucleotide sequence which is complementary to a portion of a nucleotide sequence comprising positions corresponding to: positions 167,121-167,124 according to SEQ ID NO:2, or the complement thereof; positions 2,706-2,709 according to SEQ ID NO:6, or the complement thereof; positions 2,396-2,399 according to SEQ ID NO:7, or the complement thereof; positions 2,706-2,709 according to SEQ ID NO:12, or the complement thereof; or positions 2,396-2,399 according to SEQ ID NO:13, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human ZNRF3 polypeptide, wherein the portion comprises a position corresponding to: position 166,500 according to SEQ ID NO:3, or the complement thereof; position 2,085 according to SEQ ID NO:8, or the complement thereof; position 1,775 according to SEQ ID NO:9, or the complement thereof; position 2,085 according to SEQ ID NO:14, or the complement thereof; or position 1,775 according to SEQ ID NO:15, or the complement thereof. In some embodiments, the alteration-specific probe or alteration-specific primer comprises a nucleotide sequence which is complementary to a portion of a nucleotide sequence comprising positions corresponding to: positions 166,499-166,501 according to SEQ ID NO:3, or the complement thereof; positions 2,084-2,086 according to SEQ ID NO:8, or the complement thereof; positions 1,774-1,776 according to SEQ ID NO:9, or the complement thereof; positions 2,084-2,086 according to SEQ ID NO:14, or the complement thereof; or positions 1,774-1,776 according to SEQ ID NO:15, or the complement thereof.

In some embodiments, the alteration-specific probes and alteration-specific primers comprise DNA. In some embodiments, the alteration-specific probes and alteration-specific primers comprise RNA.

In some embodiments, the probes and primers described herein (including alteration-specific probes and alteration-specific primers) have a nucleotide sequence that specifically hybridizes to any of the nucleic acid molecules disclosed herein, or the complement thereof. In some embodiments, the probes and primers specifically hybridize to any of the nucleic acid molecules disclosed herein under stringent conditions.

In some embodiments, the primers, including alteration-specific primers, can be used in second generation sequencing or high throughput sequencing. In some instances, the primers, including alteration-specific primers, can be modified. In particular, the primers can comprise various modifications that are used at different steps of, for example, Massive Parallel Signature Sequencing (MPSS), Polony sequencing, and 454 Pyrosequencing. Modified primers can be used at several steps of the process, including biotinylated primers in the cloning step and fluorescently labeled primers used at the bead loading step and detection step. Polony sequencing is generally performed using a paired-end tags library wherein each molecule of DNA template is about 135 bp in length. Biotinylated primers are used at the bead loading step and emulsion PCR. Fluorescently labeled degenerate nonamer oligonucleotides are used at the detection step. An adaptor can contain a 5'-biotin tag for immobilization of the DNA library onto streptavidin-coated beads.

The probes and primers described herein can be used to detect a nucleotide variation within any of the ZNRF3 variant genomic nucleic acid molecules, ZNRF3 variant mRNA molecules, and/or ZNRF3 variant cDNA molecules disclosed herein. The primers described herein can be used to amplify ZNRF3 variant genomic nucleic acid molecules, ZNRF3 variant mRNA molecules, or ZNRF3 variant cDNA molecules, or a fragment thereof. The present disclosure also provides pairs of primers comprising any of the primers described above.

In the context of the disclosure "specifically hybridizes" means that the probe or primer (such as, for example, the alteration-specific probe or alteration-specific primer) does not hybridize to a nucleic acid sequence encoding a ZNRF3 reference genomic nucleic acid molecule, a ZNRF3 reference mRNA molecule, and/or a ZNRF3 reference cDNA molecule.

In some embodiments, the probes (such as, for example, an alteration-specific probe) comprise a label. In some embodiments, the label is a fluorescent label, a radiolabel, or biotin.

The present disclosure also provides supports comprising a substrate to which any one or more of the probes disclosed herein is attached. Solid supports are solid-state substrates or supports with which molecules, such as any of the probes disclosed herein, can be associated. A form of solid support is an array. Another form of solid support is an array detector. An array detector is a solid support to which multiple different probes have been coupled in an array, grid, or other organized pattern. A form for a solid-state substrate is a microtiter dish, such as a standard 96-well type. In some embodiments, a multiwell glass slide can be employed that normally contains one array per well.

The present disclosure also provides molecular complexes comprising or consisting of any of the ZNRF 3 nucleic acid molecules (genomic nucleic acid molecules, mRNA molecules, or cDNA molecules), or complement thereof, described herein and any of the alteration-specific primers or alteration-specific probes described herein. In some embodiments, the ZNRF3 nucleic acid molecules (genomic nucleic acid molecules, mRNA molecules, or cDNA molecules), or complement thereof, in the molecular complexes are single-stranded. In some embodiments, the ZNRF3 nucleic acid molecule is any of the genomic nucleic acid molecules described herein. In some embodiments, the ZNRF3 nucleic acid molecule is any of the mRNA molecules described herein. In some embodiments, the ZNRF3 nucleic acid molecule is any of the cDNA molecules described herein. In some embodiments, the molecular complex comprises or consists of any of the ZNRF3 nucleic acid molecules (genomic nucleic acid molecules, mRNA molecules, or cDNA molecules), or complement thereof, described herein and any of the alteration-specific primers described herein. In some embodiments, the molecular complex comprises or consists of any of the ZNRF3 nucleic acid molecules (genomic nucleic acid molecules, mRNA molecules, or cDNA molecules), or complement thereof, described herein and any of the alteration-specific probes described herein.

In some embodiments, the molecular complex comprises or consists of an alteration-specific primer or an alteration-specific probe hybridized to a genomic nucleic acid molecule comprising a nucleotide sequence encoding a human ZNRF3 polypeptide, wherein the alteration-specific primer or the alteration-specific probe is hybridized to: a position corresponding to position 167,123 according to SEQ ID NO:2, or the complement thereof; or a position corresponding to position 166,500 according to SEQ ID NO:3, or the complement thereof.

In some embodiments, the molecular complex comprises or consists of an alteration-specific primer or an alteration-specific probe that is hybridized to: positions corresponding to positions 167,121-167,124 according to SEQ ID NO:2; or positions corresponding to positions 166,499-166,501 according to SEQ ID NO:3.

In some embodiments, the genomic nucleic acid molecule in the molecular complex comprises or consists of SEQ ID NO:2 or SEQ ID NO:3. In some embodiments, the genomic nucleic acid molecule in the molecular complex comprises or consists of SEQ ID NO:2. In some embodiments, the genomic nucleic acid molecule in the molecular complex comprises or consists of SEQ ID NO:3.

In some embodiments, the molecular complex comprises or consists of an alteration-specific primer or an alteration-specific probe hybridized to an mRNA molecule comprising a nucleotide sequence encoding a human ZNRF3 polypeptide, wherein the alteration-specific primer or the alteration-specific probe is hybridized to: a position corresponding to position 2,708 according to SEQ ID NO:6, or the complement thereof; a position corresponding to position 2,398 according to SEQ ID NO:7, or the complement thereof; a position corresponding to position 2,085 according to SEQ ID NO:8, or the complement thereof; or a position corresponding to position 1,175 according to SEQ ID NO:9, or the complement thereof.

In some embodiments, the molecular complex comprises or consists of an alteration-specific primer or an alteration-specific probe that is hybridized to: positions corresponding to positions 2,706-2,709 according to SEQ ID NO:6; positions corresponding to positions 2,396-2,399 according to SEQ ID NO:7; positions corresponding to positions 2,084-2,086 according to SEQ ID NO:8; or positions corresponding to positions 1,774-1,776 according to SEQ ID NO:9.

In some embodiments, the mRNA molecule in the molecular complex comprises or consists of SEQ ID NO:6, SEQ ID NO:7, SEQ ID NO:8, or SEQ ID NO:9. In some embodiments, the mRNA molecule in the molecular complex comprises or consists of SEQ ID NO:6. In some embodiments, the mRNA molecule in the molecular complex comprises or consists of SEQ ID NO:7. In some embodiments, the mRNA molecule in the molecular complex comprises or consists of SEQ ID NO:8. In some embodiments, the mRNA molecule in the molecular complex comprises or consists of SEQ ID NO:9.

In some embodiments, the molecular complex comprises or consists of an alteration-specific primer or an alteration-specific probe hybridized to a cDNA molecule comprising a nucleotide sequence encoding a human ZNRF3 polypeptide, wherein the alteration-specific primer or the alteration-specific probe is hybridized to: a position corresponding to position 2,708 according to SEQ ID NO:12, or the complement thereof; a position corresponding to position 2,398 according to SEQ ID NO:13, or the complement thereof; a position corresponding to position 2,085 according to SEQ ID NO:14, or the complement thereof; or a position corresponding to position 1,175 according to SEQ ID NO:15, or the complement thereof.

In some embodiments, the molecular complex comprises or consists of an alteration-specific primer or an alteration-specific probe that is hybridized to: positions corresponding to positions 2,706-2,709 according to SEQ ID NO:12; positions corresponding to positions 2,396-2,399 according to SEQ ID NO:13; positions corresponding to positions 2,084-2,086 according to SEQ ID NO:14; or positions corresponding to positions 1,774-1,776 according to SEQ ID NO:15.

In some embodiments, the cDNA molecule in the molecular complex comprises or consists of SEQ ID NO:12, SEQ ID NO:13, SEQ ID NO:14, or SEQ ID NO:15. In some embodiments, the cDNA molecule in the molecular complex comprises or consists of SEQ ID NO:12. In some embodiments, the cDNA molecule in the molecular complex comprises or consists of SEQ ID NO:13. In some embodiments, the cDNA molecule in the molecular complex comprises or consists of SEQ ID NO:14. In some embodiments, the cDNA molecule in the molecular complex comprises or consists of SEQ ID NO:15.

In some embodiments, the molecular complex comprises an alteration-specific probe or an alteration-specific primer comprising a label. In some embodiments, the label is a fluorescent label, a radiolabel, or biotin. In some embodiments, the molecular complex further comprises a non-human polymerase.

The present disclosure also provides isolated nucleic acid molecules comprising a nucleotide sequence encoding a human ZNRF3 variant polypeptide. In some embodiments, the ZNRF3 variant polypeptide comprises a sequence according to SEQ ID NO:18 or SEQ ID NO:19, or the complement thereof. In some embodiments, the isolated nucleic acid molecule encodes a ZNRF3 variant polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:18 or SEQ ID NO:19. In some embodiments, the isolated nucleic acid molecule encodes a ZNRF3 variant polypeptide having an amino acid sequence that has at least about 90% sequence identity to SEQ ID NO:18 or SEQ ID NO:19. In some embodiments, the isolated nucleic acid molecule encodes a ZNRF3 variant polypeptide having an amino acid sequence that has at least about 92% sequence identity to SEQ ID NO:18 or SEQ ID NO:19. In some embodiments, the isolated nucleic acid molecule encodes a ZNRF3 variant polypeptide having an amino acid sequence that has at least about 94% sequence identity to SEQ ID NO:18 or SEQ ID NO:19. In some embodiments, the isolated nucleic acid molecule encodes a ZNRF3 variant polypeptide having an amino acid sequence that has at least about 96% sequence identity to SEQ ID NO:18 or SEQ ID NO:19. In some embodiments, the isolated nucleic acid molecule encodes a ZNRF3 variant polypeptide having an amino acid sequence that has at least about 98% sequence identity to SEQ ID NO:18 or SEQ ID NO:19. In some embodiments, the nucleic acid molecule encodes a ZNRF3 variant polypeptide comprising SEQ ID NO:18 or SEQ ID NO:19. In some embodiments, the nucleic acid molecule encodes a ZNRF3 variant polypeptide consisting of SEQ ID NO:18 or SEQ ID NO:19.

In some embodiments, the ZNRF3 variant polypeptide comprises a serine at the position corresponding to position 844 according to SEQ ID NO:18, or a serine at the position corresponding to position 744 according to SEQ ID NO:19, or the complement thereof. In some embodiments, the isolated nucleic acid molecule encodes a ZNRF3 variant polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:18 or SEQ ID NO:19, and comprises a serine at the position corresponding to position 844 according to SEQ ID NO:18, or a serine at the position corresponding to position 744 according to SEQ ID NO:19. In some embodiments, the isolated nucleic acid molecule encodes a ZNRF3 variant polypeptide having an amino acid sequence that has at least about 90% sequence identity to SEQ ID NO:18 or SEQ ID NO:19, and comprises a serine at the position corresponding to position 844 according to SEQ ID NO:18, or a serine at the position corresponding to position 744 according to SEQ ID NO:19. In some embodiments, the isolated nucleic acid molecule encodes a ZNRF3 variant polypeptide having an amino acid sequence that has at least about 92% sequence identity to SEQ ID NO:18 or SEQ ID NO:19, and comprises a serine at the position corresponding to position 844 according to SEQ ID NO:18, or a serine at the position corresponding to position 744 according to SEQ ID NO:19. In some embodiments, the isolated nucleic acid molecule encodes a ZNRF3 variant polypeptide having an amino acid sequence that has at least about 94% sequence identity to SEQ ID NO:18 or SEQ ID NO:19, and comprises a serine at the position corresponding to position 844 according to SEQ ID NO:18, or a serine at the position corresponding to position 744 according to SEQ ID NO:19. In some embodiments, the isolated nucleic acid molecule encodes a ZNRF3 variant polypeptide having an amino acid sequence that has at least about 96% sequence identity to SEQ ID NO:18 or SEQ ID NO:19, and comprises a serine at the position corresponding to position 844 according to SEQ ID NO:18, or a serine at the position corresponding to position 744 according to SEQ ID NO:19. In some embodiments, the isolated nucleic acid molecule encodes a ZNRF3 variant polypeptide having an amino acid sequence that has at least about 98% sequence identity to SEQ ID NO:18 or SEQ ID NO:19, and comprises a serine at the position corresponding to position 844 according to SEQ ID NO:18, or a serine at the position corresponding to position 744 according to SEQ ID NO:19. In some embodiments, the nucleic acid molecule encodes a ZNRF3 variant polypeptide comprising SEQ ID NO:18 or SEQ ID NO:19. In some embodiments, the nucleic acid molecule encodes a ZNRF3 variant polypeptide comprising SEQ ID NO:18. In some embodiments, the nucleic acid molecule encodes a ZNRF3 variant polypeptide comprising SEQ ID NO:19. In some embodiments, the nucleic acid molecule encodes a ZNRF3 variant polypeptide consisting of SEQ ID NO:18 or SEQ ID NO:19. In some embodiments, the nucleic acid molecule encodes a ZNRF3 variant polypeptide consisting of SEQ ID NO:18. In some embodiments, the nucleic acid molecule encodes a ZNRF3 variant polypeptide consisting of SEQ ID NO:19.

The nucleotide sequence of a ZNRF3 reference genomic nucleic acid molecule is set forth in SEQ ID NO:1. Referring to SEQ ID NO:1, position 167,122 is a guanine. Referring to SEQ ID NO:1, position 166,500 is an adenine.

A variant genomic nucleic acid molecule of ZNRF3 exists, wherein the guanine at a position corresponding to position 167,122 according to SEQ ID NO:1 is deleted. The nucleotide sequence of this ZNRF3 variant genomic nucleic acid molecule is set forth in SEQ ID NO:2.

Another variant genomic nucleic acid molecule of ZNRF3 exists, wherein the adenine at a position corresponding to position 166,500 is replaced with guanine. The nucleotide sequence of this ZNRF3 variant genomic nucleic acid molecule is set forth in SEQ ID NO:3. The nucleotide sequence of this variant genomic nucleic acid molecule comprises a CGC codon at positions corresponding to positions 166,499-166,501 according to SEQ ID NO:3.

The present disclosure also provides isolated genomic nucleic acid molecules comprising or consisting of a nucleotide sequence encoding a human ZNRF3 polypeptide. In some embodiments, the nucleotide sequence of the genomic nucleic acid molecule lacks a guanine at a position corresponding to position 167,122 according to SEQ ID NO:1, or the complement thereof. In some embodiments, the isolated genomic nucleic acid molecules comprise or consist of a nucleotide sequence encoding a human ZNRF3 polypeptide, wherein the nucleotide sequence comprises a frameshift at positions corresponding to positions 167,120-167,122 according to SEQ ID NO:2. In some embodiments, the isolated genomic nucleic acid molecules comprise or consist of a nucleotide sequence encoding a human ZNRF3 polypeptide, wherein the nucleotide sequence comprises or consists of SEQ ID NO:2.

In some embodiments, the isolated genomic nucleic acid molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:2, and lacks a guanine at a position corresponding to position 167,122 according to SEQ ID NO:1, or the complement thereof. In some embodiments, the isolated genomic nucleic acid molecules comprise or consist of a nucleotide sequence that has at least about 90% sequence identity to SEQ ID NO:2, and lacks a guanine at a position corresponding to position 167,122 according to SEQ ID NO:1, or the complement thereof. In some embodiments, the isolated genomic nucleic acid molecules comprise or consist of a nucleotide sequence that has at least about 92% sequence identity to SEQ ID NO:2, and lacks a guanine at a position corresponding to position 167,122 according to SEQ ID NO:1, or the complement thereof. In some embodiments, the isolated genomic nucleic acid molecules comprise or consist of a nucleotide sequence that has at least about 94% sequence identity to SEQ ID NO:2, and lacks a guanine at a position corresponding to position 167,122 according to SEQ ID NO:1, or the complement thereof. In some embodiments, the isolated genomic nucleic acid molecules comprise or consist of a nucleotide sequence that has at least about 96% sequence identity to SEQ ID NO:2, and lacks a guanine at a position corresponding to position 167,122 according to SEQ ID NO:1, or the complement thereof. In some embodiments, the isolated genomic nucleic acid molecules comprise or consist of a nucleotide sequence that has at least about 98% sequence identity to SEQ ID NO:2, and lacks a guanine at a position corresponding to position 167,122 according to SEQ ID NO:1, or the complement thereof.

Herein, if reference is made to percent sequence identity, the higher percentages of sequence identity are preferred over the lower ones.

In some embodiments, the isolated genomic nucleic acid molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:2, and comprises a frameshift at positions corresponding to positions 167,120-167,122 according to SEQ ID NO:2, or the complement thereof. In some embodiments, the isolated genomic nucleic acid molecules comprise or consist of a nucleotide sequence that has at least about 90% sequence identity to SEQ ID NO:2, and comprises a frameshift at positions corresponding to positions 167,120-167,122 according to SEQ ID NO:2, or the complement thereof. In some embodiments, the isolated genomic nucleic acid molecules comprise or consist of a nucleotide sequence that has at least about 92% sequence identity to SEQ ID NO:2, and comprises a frameshift at positions corresponding to positions 167,120-167,122 according to SEQ ID NO:2, or the complement thereof. In some embodiments, the isolated genomic nucleic acid molecules comprise or consist of a nucleotide sequence that has at least about 94% sequence identity to SEQ ID NO:2, and comprises a frameshift at positions corresponding to positions 167,120-167,122 according to SEQ ID NO:2, or the complement thereof. In some embodiments, the isolated genomic nucleic acid molecules comprise or consist of a nucleotide sequence that has at least about 96% sequence identity to SEQ ID NO:2, and comprises a frameshift at positions corresponding to positions 167,120-167,122 according to SEQ ID NO:2, or the complement thereof. In some embodiments, the isolated genomic nucleic acid molecules comprise or consist of a nucleotide sequence that has at least about 98% sequence identity to SEQ ID NO:2, and comprises a frameshift at positions corresponding to positions 167,120-167,122 according to SEQ ID NO:2, or the complement thereof.

Herein, if reference is made to percent sequence identity, the higher percentages of sequence identity are preferred over the lower ones.

In some embodiments, the isolated genomic nucleic acid molecule comprises SEQ ID NO:2. In some embodiments, the isolated genomic nucleic acid molecule consists of SEQ ID NO:2.

In some embodiments, the isolated genomic nucleic acid molecules comprise less than the entire genomic DNA sequence. In some embodiments, the isolated genomic nucleic acid molecules comprise or consist of at least about 15, at least about 20, at least about 25, at least about 30, at least about 35, at least about 40, at least about 45, at least about 50, at least about 60, at least about 70, at least about 80, at least about 90, at least about 100, at least about 200, at least about 300, at least about 400, at least about 500, at least about 600, at least about 700, at least about 800, at least about 900, at least about 1000, at least about 2000, at least about 3000, at least about 4000, at least about 5000, at least about 6000, at least about 7000, at least about 8000, at least about 9000, or at least about 10000 contiguous nucleotides of any of the ZNRF3 genomic nucleic acid molecules disclosed herein. In some embodiments, the isolated genomic nucleic acid molecules comprise or consist of at least about 1000 to at least about 2000 contiguous nucleotides of any of the ZNRF3 genomic nucleic acid molecules disclosed herein. In some embodiments, these isolated genomic nucleic acid molecules lack the guanine at a position corresponding to position 167,122 according to SEQ ID NO:1.

The nucleotide sequences of ZNRF3 reference mRNA molecules are set forth in SEQ ID NO:4 and SEQ ID NO:5. Referring to SEQ ID NO:4 and SEQ ID NO:5, positions 2,707 and 2,397, respectively, are a guanine. Referring to SEQ ID NO:4 and SEQ ID NO:5, positions 2,085 and 1,775, respectively, are an adenine.

A variant mRNA molecule of ZNRF3 exists, wherein the guanine at a position corresponding to position 2,707 of SEQ ID NO:4, or at a position corresponding to position 2,397 of SEQ ID NO:5 is deleted. The nucleotide sequence of these ZNRF3 variant mRNA molecules is set forth in SEQ ID NO:6 and SEQ ID NO:7, respectively.

Another variant mRNA molecule of ZNRF3 exists, wherein the adenine at a position corresponding to position 2,085 according to SEQ ID NO:4, or at a position corresponding to position 1,775 according to SEQ ID NO:5 is replaced with guanine. The nucleotide sequence of these ZNRF3 variant mRNA molecules is set forth in SEQ ID NO:8 and SEQ ID NO:9, respectively. The nucleotide sequence of this variant mRNA molecule comprises a CGC codon at positions corresponding to positions 2,084-2,086 according to SEQ ID NO:8, or comprises a CGC codon at positions corresponding to positions 1,774-1,776 according to SEQ ID NO:9.

The present disclosure also provides isolated mRNA molecules comprising or consisting of a nucleotide sequence encoding a human ZNRF3 polypeptide, wherein the nucleotide sequence lacks a guanine at a position corresponding to position 2,707 according to SEQ ID NO:4, or the complement thereof, or lacks a guanine at a position corresponding to position 2,397 according to SEQ ID NO:5, or the complement thereof. In some embodiments, the isolated mRNA molecule comprises or consists of a nucleotide sequence encoding a human ZNRF3 polypeptide, wherein the nucleotide sequence comprises a sequence comprising a frameshift at positions corresponding to positions 2,705-2,707 according to SEQ ID NO:6, or comprises a sequence comprising a frameshift at positions corresponding to positions 2,395-2,397 according to SEQ ID NO:7.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:6 or SEQ ID NO:7, and lacks a guanine at a position corresponding to position 2,707 according to SEQ ID NO:4, or lacks a guanine at a position corresponding to position 2,397 according to SEQ ID NO:7, or the complement thereof. In some embodiments, the isolated mRNA molecules comprise or consist of a nucleotide sequence that has at least about 90% sequence identity to SEQ ID NO:6 or SEQ ID NO:7, and lacks a guanine at a position corresponding to position 2,707 according to SEQ ID NO:4, or lacks a guanine at a position corresponding to position 2,397 according to SEQ ID NO:7, or the complement thereof. In some embodiments, the isolated mRNA molecules comprise or consist of a nucleotide sequence that has at least about 92% sequence identity to SEQ ID NO:6 or SEQ ID NO:7, and lacks a guanine at a position corresponding to position 2,707 according to SEQ ID NO:4, or lacks a guanine at a position corresponding to position 2,397 according to SEQ ID NO:7, or the complement thereof. In some embodiments, the isolated mRNA molecules comprise or consist of a nucleotide sequence that has at least about 94% sequence identity to SEQ ID NO:6 or SEQ ID NO:7, and lacks a guanine at a position corresponding to position 2,707 according to SEQ ID NO:4, or lacks a guanine at a position corresponding to position 2,397 according to SEQ ID NO:7, or the complement thereof. In some embodiments, the isolated mRNA molecules comprise or consist of a nucleotide sequence that has at least about 96% sequence identity to SEQ ID NO:6 or SEQ ID NO:7, and lacks a guanine at a position corresponding to position 2,707 according to SEQ ID NO:4, or lacks a guanine at a position corresponding to position 2,397 according to SEQ ID NO:7, or the complement thereof. In some embodiments, the isolated mRNA molecules comprise or consist of a nucleotide sequence that has at least about 98% sequence identity to SEQ ID NO:6 or SEQ ID NO:7, and lacks a guanine at a position corresponding to position 2,707 according to SEQ ID NO:4, or lacks a guanine at a position corresponding to position 2,397 according to SEQ ID NO:7, or the complement thereof.

Herein, if reference is made to percent sequence identity, the higher percentages of sequence identity are preferred over the lower ones.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:6 or SEQ ID NO:7, and comprises a frameshift at positions corresponding to positions 2,705-2,707 according to SEQ ID NO:6, or comprises a frameshift at positions corresponding to positions 2,395-2,397 according to SEQ ID NO:7, or the complement thereof. In some embodiments, the isolated mRNA molecules comprise or consist of a nucleotide sequence that has at least about 90% sequence identity to SEQ ID NO:6 or SEQ ID NO:7, and comprises a frameshift at positions corresponding to positions 2,705-2,707 according to SEQ ID NO:6, or comprises a frameshift at positions corresponding to positions 2,395-2,397 according to SEQ ID NO:7, or the complement thereof. In some embodiments, the isolated mRNA molecules comprise or consist of a nucleotide sequence that has at least about 92% sequence identity to SEQ ID NO:6 or SEQ ID NO:7, and comprises a frameshift at positions corresponding to positions 2,705-2,707 according to SEQ ID NO:6, or comprises a frameshift at positions corresponding to positions 2,395-2,397 according to SEQ ID NO:7, or the complement thereof. In some embodiments, the isolated mRNA molecules comprise or consist of a nucleotide sequence that has at least about 94% sequence identity to SEQ ID NO:6 or SEQ ID NO:7, and comprises a frameshift at positions corresponding to positions 2,705-2,707 according to SEQ ID NO:6, or comprises a frameshift at positions corresponding to positions 2,395-2,397 according to SEQ ID NO:7, or the complement thereof. In some embodiments, the isolated mRNA molecules comprise or consist of a nucleotide sequence that has at least about 96% sequence identity to SEQ ID NO:6 or SEQ ID NO:7, and comprises a frameshift at positions corresponding to positions 2,705-2,707 according to SEQ ID NO:6, or comprises a frameshift at positions corresponding to positions 2,395-2,397 according to SEQ ID NO:7, or the complement thereof. In some embodiments, the isolated mRNA molecules comprise or consist of a nucleotide sequence that has at least about 98% sequence identity to SEQ ID NO:6 or SEQ ID NO:7, and comprises a frameshift at positions corresponding to positions 2,705-2,707 according to SEQ ID NO:6, or comprises a frameshift at positions corresponding to positions 2,395-2,397 according to SEQ ID NO:7, or the complement thereof.

Herein, if reference is made to percent sequence identity, the higher percentages of sequence identity are preferred over the lower ones.

In some embodiments, the isolated mRNA molecule comprises SEQ ID NO:6. In some embodiments, the isolated mRNA molecule consists of SEQ ID NO:6. In some embodiments, the isolated mRNA molecule comprises SEQ ID NO:7. In some embodiments, the isolated mRNA molecule consists of SEQ ID NO:7.

The nucleotide sequences of ZNRF3 reference cDNA molecules are set forth in SEQ ID NO:10 and SEQ ID NO:11. Referring to SEQ ID NO:10 and SEQ ID NO:11, positions 2,707 and 2,397, respectively, are a guanine. Referring to SEQ ID NO:10 and SEQ ID NO:11, positions 2,085 and 1,775, respectively, are an adenine.

A variant cDNA molecule of ZNRF3 exists, wherein the guanine at a position corresponding to position 2,707 according to SEQ ID NO:10, or at a position corresponding to position 2,397 according to SEQ ID NO:11 is deleted. The nucleotide sequence of these ZNRF3 variant cDNA molecules is set forth in SEQ ID NO:12 and SEQ ID NO:13, respectively.

Another variant cDNA molecule of ZNRF3 exists, wherein the adenine at a position corresponding to position 2,085 according to SEQ ID NO:10, or at a position corresponding to position 1,775 according to SEQ ID NO:11 is replaced with guanine. The nucleotide sequence of these ZNRF3 variant cDNA molecules is set forth in SEQ ID NO:15 and SEQ ID NO:16, respectively. The nucleotide sequence of this variant mRNA molecule comprises a CGC codon at positions corresponding to positions 2,084-2,086 according to SEQ ID NO:14, or at positions corresponding to positions 1,774-1,776 according to SEQ ID NO:15.

The present disclosure provides isolated cDNA molecules comprising or consisting of a nucleotide sequence encoding a human ZNRF3 polypeptide, wherein the nucleotide sequence lacks a guanine at a position corresponding to position 2,707 according to SEQ ID NO:10 or the complement thereof, or lacks a guanine at a position corresponding to position 2,397 according to SEQ ID NO:11, or the complement thereof. In some embodiments, these isolated cDNA molecules comprise a nucleotide sequence encoding a human ZNRF3 polypeptide, wherein the nucleotide sequence comprises a frameshift at positions corresponding to positions 2,705-2,707 according to SEQ ID NO:12, or comprises a frameshift at positions corresponding to positions 2,395-2,397 according to SEQ ID NO:13.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:12 or SEQ ID NO:13, and lacks a guanine at a position corresponding to position 2,707 according to SEQ ID NO:12, or at a position corresponding to position 2,397 according to SEQ ID NO:13, or the complement thereof. In some embodiments, the isolated cDNA molecules comprise or consist of a nucleotide sequence that has at least about 90% sequence identity to SEQ ID NO:12 or SEQ ID NO:13, and lacks a guanine at a position corresponding to position 2,707 according to SEQ ID NO:12, or at a position corresponding to position 2,397 according to SEQ ID NO:13, or the complement thereof. In some embodiments, the isolated cDNA molecules comprise or consist of a nucleotide sequence that has at least about 92% sequence identity to SEQ ID NO:12 or SEQ ID NO:13, and lacks a guanine at a position corresponding to position 2,707 according to SEQ ID NO:12, or at a position corresponding to position 2,397 according to SEQ ID NO:13, or the complement thereof. In some embodiments, the isolated cDNA molecules comprise or consist of a nucleotide sequence that has at least about 94% sequence identity to SEQ ID NO:12 or SEQ ID NO:13, and lacks a guanine at a position corresponding to position 2,707 according to SEQ ID NO:12, or at a position corresponding to position 2,397 according to SEQ ID NO:13, or the complement thereof. In some embodiments, the isolated cDNA molecules comprise or consist of a nucleotide sequence that has at least about 96% sequence identity to SEQ ID NO:12 or SEQ ID NO:13, and lacks a guanine at a position corresponding to position 2,707 according to SEQ ID NO:12, or at a position corresponding to position 2,397 according to SEQ ID NO:13, or the complement thereof. In some embodiments, the isolated cDNA molecules comprise or consist of a nucleotide sequence that has at least about 98% sequence identity to SEQ ID NO:12 or SEQ ID NO:13, and lacks a guanine at a position corresponding to position 2,707 according to SEQ ID NO:12, or at a position corresponding to position 2,397 according to SEQ ID NO:13, or the complement thereof.

Herein, if reference is made to percent sequence identity, the higher percentages of sequence identity are preferred over the lower ones.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:12 or SEQ ID NO:13, and comprises a frameshift at positions corresponding to positions 2,705-2,707 according to SEQ ID NO:12, or comprises a frameshift at positions corresponding to positions 2,395-2,397 according to SEQ ID NO:13, or the complement thereof. In some embodiments, the isolated cDNA molecules comprise or consist of a nucleotide sequence that has at least about 90% sequence identity to SEQ ID NO:12 or SEQ ID NO:13, and comprises a frameshift at positions corresponding to positions 2,705-2,707 according to SEQ ID NO:12, or comprises a frameshift at positions corresponding to positions 2,395-2,397 according to SEQ ID NO:13, or the complement thereof. In some embodiments, the isolated cDNA molecules comprise or consist of a nucleotide sequence that has at least about 92% sequence identity to SEQ ID NO:12 or SEQ ID NO:13, and comprises a frameshift at positions corresponding to positions 2,705-2,707 according to SEQ ID NO:12, or comprises a frameshift at positions corresponding to positions 2,395-2,397 according to SEQ ID NO:13, or the complement thereof. In some embodiments, the isolated cDNA molecules comprise or consist of a nucleotide sequence that has at least about 94% sequence identity to SEQ ID NO:12 or SEQ ID NO:13, and comprises a frameshift at positions corresponding to positions 2,705-2,707 according to SEQ ID NO:12, or comprises a frameshift at positions corresponding to positions 2,395-2,397 according to SEQ ID NO:13, or the complement thereof. In some embodiments, the isolated cDNA molecules comprise or consist of a nucleotide sequence that has at least about 96% sequence identity to SEQ ID NO:12 or SEQ ID NO:13, and comprises a frameshift at positions corresponding to positions 2,705-2,707 according to SEQ ID NO:12, or comprises a frameshift at positions corresponding to positions 2,395-2,397 according to SEQ ID NO:13, or the complement thereof. In some embodiments, the isolated cDNA molecules comprise or consist of a nucleotide sequence that has at least about 98% sequence identity to SEQ ID NO:12 or SEQ ID NO:13, and comprises a frameshift at positions corresponding to positions 2,705-2,707 according to SEQ ID NO:12, or comprises a frameshift at positions corresponding to positions 2,395-2,397 according to SEQ ID NO:13, or the complement thereof.

Herein, if reference is made to percent sequence identity, the higher percentages of sequence identity are preferred over the lower ones.

In some embodiments, the isolated cDNA molecule comprises SEQ ID NO:12. In some embodiments, the isolated cDNA molecule consists of SEQ ID NO:12. In some embodiments, the isolated cDNA molecule comprises SEQ ID NO:13. In some embodiments, the isolated cDNA molecule consists of SEQ ID NO:13.

In some embodiments, the isolated mRNA molecules or cDNA molecules comprise less than the entire mRNA or cDNA sequence. In some embodiments, the isolated mRNA molecules or cDNA molecules comprise or consist of at least about 5, at least about 8, at least about 10, at least about 12, at least about 15, at least about 20, at least about 25, at least about 30, at least about 35, at least about 40, at least about 45, at least about 50, at least about 60, at least about 70, at least about 80, at least about 90, at least about 100, at least about 200, at least about 300, at least about 400, at least about 500, at least about 600, at least about 700, at least about 800, at least about 900, at least about 1000, at least about 1100, at least about 1200, at least about 1300, at least about 1400, at least about 1500, at least about 1600, at least about 1700, at least about 1800, at least about 1900, or at least about 2000 contiguous nucleotides of any of the ZNRF3 mRNA molecules or cDNA molecules disclosed herein. In some embodiments, the isolated mRNA molecules or cDNA molecules comprise or consist of at least about 400 to at least about 500 contiguous nucleotides of any of the ZNRF3 mRNA molecules or cDNA molecules disclosed herein. In some embodiments, the isolated cDNA molecules comprise or consist of at least about 1000 to at least about 2000 contiguous nucleotides of any of the ZNRF3 mRNA molecules or cDNA molecules disclosed herein. In some embodiments, these isolated mRNA molecules or cDNA molecules comprise a frameshift at a position corresponding to position 2,707 according to SEQ ID NO:6 or SEQ ID NO:12, or comprise a frameshift at a position corresponding to position 2,397 according to SEQ ID NO:7 or SEQ ID NO:13.

The genomic nucleic acid molecules, mRNA molecules, and cDNA molecules can be from any organism. For example, the genomic nucleic acid molecules, mRNA molecules, and cDNA molecules can be human or an ortholog from another organism, such as a non-human mammal, a rodent, a mouse, or a rat. It is understood that gene sequences within a population can vary due to polymorphisms such as single-nucleotide polymorphisms. The examples provided herein are only exemplary sequences. Other sequences are also possible.

The present disclosure also provides fragments of any of the isolated genomic nucleic acid molecules, mRNA molecules, or cDNA molecules disclosed herein. In some embodiments, the fragments comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, or at least about 100 contiguous residues of any of the nucleic acid molecules disclosed herein, or any complement thereof. In some embodiments, the fragments comprise or consist of at least about 20, at least about 25, at least about 30, or at least about 35 contiguous residues of any of the nucleic acid molecules disclosed herein, or any complement thereof. In this regard, the longer fragments are preferred over the shorter ones. Such fragments may be used, for example, as probes, primers, alteration-specific probes, or alteration-specific primers as described or exemplified herein, and include, without limitation primers, probes, antisense RNAs, shRNAs, and siRNAs, each of which is described in more detail elsewhere herein.

Also provided herein are functional polynucleotides that can interact with the disclosed nucleic acid molecules. Examples of functional polynucleotides include, but are not limited to, antisense molecules, aptamers, ribozymes, triplex forming molecules, and external guide sequences. The functional polynucleotides can act as effectors, inhibitors, modulators, and stimulators of a specific activity possessed by a target molecule, or the functional polynucleotides can possess a de novo activity independent of any other molecules.

The isolated nucleic acid molecules disclosed herein can comprise RNA, DNA, or both RNA and DNA. The isolated nucleic acid molecules can also be linked or fused to a heterologous nucleic acid sequence, such as in a vector, or a heterologous label. For example, the isolated nucleic acid molecules disclosed herein can be within a vector or as an exogenous donor sequence comprising the isolated nucleic acid molecule and a heterologous nucleic acid sequence. The isolated nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidate (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3×FLAG, 6×His or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

The disclosed nucleic acid molecules can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophore-labeled nucleotides.

The nucleic acid molecules disclosed herein can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenine-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (such as, for example, 5-bromo), 5-trifluoromethyl and other 5-substituted uracils and cytosines, 7-methylguanine, 7-methyladenine, 8-azaguanine, 8-azaadenine, 7-deazaguanine, 7-deazaadenine, 3-deazaguanine, and 3-deazaadenine.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_{1-10}$alkyl or $C_{2-10}$alkenyl, and $C_{2-10}$alkynyl. Exemplary 2' sugar modifications also include, but are not limited to, $-O[(CH_2)_nO]_mCH_3$, $-O(CH_2)_nOCH_3$, $-O(CH_2)_nNH_2$, $-O(CH_2)_nCH_3$, $-O(CH_2)_n-ONH_2$, and $-O(CH_2)_nON[(CH_2)_nCH_3]_2$, where n and m are from 1 to about 10. Other modifications at the 2' position include, but are not limited to, $C_{1-10}$alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as $CH_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts, and free acid forms are also included. Nucleotide substitutes also include peptide nucleic acids (PNAs).

The present disclosure also provides vectors comprising any one or more of the nucleic acid molecules disclosed herein. In some embodiments, the vectors comprise any one or more of the nucleic acid molecules disclosed herein and a heterologous nucleic acid. The vectors can be viral or nonviral vectors capable of transporting a nucleic acid molecule. In some embodiments, the vector is a plasmid or cosmid (such as, for example, a circular double-stranded DNA into which additional DNA segments can be ligated). In some embodiments, the vector is a viral vector, wherein additional DNA segments can be ligated into the viral genome. Expression vectors include, but are not limited to, plasmids, cosmids, retroviruses, adenoviruses, adeno-associated viruses (AAV), plant viruses such as cauliflower mosaic virus and tobacco mosaic virus, yeast artificial chromosomes (YACs), Epstein-Barr (EBV)-derived episomes, and other expression vectors known in the art.

Desired regulatory sequences for mammalian host cell expression can include, for example, viral elements that direct high levels of polypeptide expression in mammalian cells, such as promoters and/or enhancers derived from retroviral LTRs, cytomegalovirus (CMV) (such as, for example, CMV promoter/enhancer), Simian Virus 40 (SV40) (such as, for example, SV40 promoter/enhancer), adenovirus, (such as, for example, the adenovirus major late promoter (AdMLP)), polyoma and strong mammalian promoters such as native immunoglobulin and actin promoters. Methods of expressing polypeptides in bacterial cells or fungal cells (such as, for example, yeast cells) are also well known. A promoter can be, for example, a constitutively active promoter, a conditional promoter, an inducible promoter, a temporally restricted promoter (such as, for example, a developmentally regulated promoter), or a spatially restricted promoter (such as, for example, a cell-specific or tissue-specific promoter).

Percent identity (or percent complementarity) between particular stretches of nucleotide sequences within nucleic acid molecules or amino acid sequences within polypeptides can be determined routinely using BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482-489). Herein, if reference is made to percent sequence identity, the higher percentages of sequence identity are preferred over the lower ones.

The present disclosure also provides compositions comprising any one or more of the isolated nucleic acid molecules, genomic nucleic acid molecules, mRNA molecules, and/or cDNA molecules disclosed herein. In some embodiments, the composition is a pharmaceutical composition. In some embodiments, the compositions comprise a carrier and/or excipient. Examples of carriers include, but are not limited to, poly(lactic acid) (PLA) microspheres, poly(D,L-lactic-coglycolic-acid) (PLGA) microspheres, liposomes, micelles, inverse micelles, lipid cochleates, and lipid microtubules. A carrier may comprise a buffered salt solution such as PBS, HBSS, etc.

As used herein, the phrase "corresponding to" or grammatical variations thereof when used in the context of the numbering of a particular nucleotide or nucleotide sequence or position refers to the numbering of a specified reference sequence when the particular nucleotide or nucleotide sequence is compared to a reference sequence (such as, for example, SEQ ID NO:1, SEQ ID NO:4, or SEQ ID NO:10). In other words, the residue (such as, for example, nucleotide or amino acid) number or residue (such as, for example, nucleotide or amino acid) position of a particular polymer is designated with respect to the reference sequence rather than by the actual numerical position of the residue within the particular nucleotide or nucleotide sequence. For example, a particular nucleotide sequence can be aligned to a reference sequence by introducing gaps to optimize residue matches between the two sequences. In these cases, although the gaps are present, the numbering of the residue in the particular nucleotide or nucleotide sequence is made with respect to the reference sequence to which it has been aligned.

For example, a nucleic acid molecule comprising a nucleotide sequence encoding a human ZNRF3 polypeptide, wherein the nucleotide sequence lacks a guanine at a position corresponding to position 167,122 according to SEQ ID NO:1 means that if the nucleotide sequence of the ZNRF3 genomic nucleic acid molecule is aligned to the sequence of SEQ ID NO:1, the ZNRF3 sequence has a deletion of a guanine residue at the position that corresponds to position 167,122 of SEQ ID NO:1 (such as SEQ ID NO:2). The same applies for mRNA molecules comprising a nucleotide sequence encoding a human ZNRF3 polypeptide, wherein the nucleotide sequence lacks a guanine at a position corresponding to position 2,707 according to SEQ ID NO:4 (such as SEQ ID NO:6), or lacks a guanine at a position corresponding to position 2,397 according to SEQ ID NO:5 (such as SEQ ID NO:7), and cDNA molecules comprising a nucleotide sequence encoding a human ZNRF3 polypeptide, wherein the nucleotide sequence lacks a guanine at a position corresponding to position 2,707 according to SEQ ID NO:10 (such as SEQ ID NO:12), or lacks a guanine at a position corresponding to position 2,397 according to SEQ ID NO:11 (such as SEQ ID NO:13). In other words, these phrases refer to a nucleic acid molecule encoding a ZNRF3 polypeptide, wherein the genomic nucleic acid molecule has a nucleotide sequence that lacks a guanine residue that is homologous to the guanine residue at position 167,122 according to SEQ ID NO:1 (or wherein the mRNA molecule has a nucleotide sequence that lacks a guanine residue that is homologous to the guanine residue at position 2,707 according to SEQ ID NO:4, or wherein the cDNA molecule has a nucleotide sequence that lacks a guanine residue that is homologous to the guanine residue at position 2,707 according to SEQ ID NO:10). Herein, such a sequence is also referred to as "ZNRF3 sequence with the TCG→TC alteration" or "ZNRF3 sequence with the TCG→TC variation" referring to genomic nucleic acid molecules (or "ZNRF3 sequence with the UCG→UC alteration" or "ZNRF3 sequence with the UCG→UC variation" referring to mRNA molecules, and "ZNRF3 sequence with the TCG→TC alteration" or "ZNRF3 sequence with the TCG→TC variation" referring to cDNA molecules).

As described herein, a position within a ZNRF3 genomic nucleic acid molecule that corresponds to position 167,122 according to SEQ ID NO:1, for example, can be identified by performing a sequence alignment between the nucleotide sequence of a particular ZNRF3 nucleic acid molecule and the nucleotide sequence of SEQ ID NO:1. A variety of computational algorithms exist that can be used for performing a sequence alignment to identify a nucleotide position that corresponds to, for example, position 167,122 in SEQ ID NO:1. For example, by using the NCBI BLAST algorithm (Altschul et al., Nucleic Acids Res., 1997, 25, 3389-3402) or CLUSTALW software (Sievers and Higgins, Methods Mol. Biol., 2014, 1079, 105-116) sequence alignments may be performed. However, sequences can also be aligned manually.

The amino acid sequences of two ZNRF3 reference polypeptide isoforms are set forth in SEQ ID NO:16 (long isoform; 936 amino acids in length) and SEQ ID NO:17 (short isoform; 836 amino acids in length). Referring to SEQ ID NO:16, position 844 is serine. Referring to SEQ ID NO:16, position 637 is histidine. Referring to SEQ ID NO:17, position 744 is serine. Referring to SEQ ID NO:17, position 537 is histidine.

A ZNRF3 variant polypeptide exists (Ser844FS), the amino acid sequence of which is set forth in SEQ ID NO:18. Referring to SEQ ID NO:18, the ZNRF3 variant polypeptide is 954 amino acids in length. Referring to SEQ ID NO:18, position 844 is serine.

Another ZNRF3 variant polypeptide exists (Ser744FS) the amino acid sequence of which is set forth in SEQ ID NO:19. Referring to SEQ ID NO:19, the ZNRF3 variant polypeptide is 854 amino acids in length. Referring to SEQ ID NO:19, position 744 is serine.

Another ZNRF3 variant polypeptide exists (His637Arg) the amino acid sequence of which is set forth in SEQ ID NO:20. Referring to SEQ ID NO:20, the ZNRF3 variant polypeptide is 936 amino acids in length. Referring to SEQ ID NO:20, position 637 is arginine.

Another ZNRF3 variant polypeptide exists (His537Arg), the amino acid sequence of which is set forth in SEQ ID NO:21. Referring to SEQ ID NO:21, the ZNRF3 variant polypeptide is 836 amino acids in length. Referring to SEQ ID NO:21, position 537 is arginine.

The present disclosure also provides isolated human ZNRF3 polypeptides having an amino acid sequence at least about 90%, at least about 91%, at least about 92%, at least about 93%, at least about 94%, at least about 95%, at least about 96%, at least about 97%, at least about 98%, or at least about 99% identical to SEQ ID NO:18. In some embodiments, the isolated human ZNRF3 polypeptides have an amino acid sequence at least about 90% identical to SEQ ID NO:18. In some embodiments, the isolated human ZNRF3 polypeptides have an amino acid sequence at least about 92% identical to SEQ ID NO:18. In some embodiments, the isolated human ZNRF3 polypeptides have an amino acid sequence at least about 94% identical to SEQ ID NO:18. In some embodiments, the isolated human ZNRF3 polypeptides have an amino acid sequence at least about 96% identical to SEQ ID NO:18. In some embodiments, the isolated human ZNRF3 polypeptides have an amino acid sequence at least about 98% identical to SEQ ID NO:18.

The present disclosure also provides isolated human ZNRF3 polypeptides having an amino acid sequence at least about 90%, at least about 91%, at least about 92%, at least about 93%, at least about 94%, at least about 95%, at least about 96%, at least about 97%, at least about 98%, or at least about 99% identical to SEQ ID NO:19. In some embodiments, the isolated human ZNRF3 polypeptides have an amino acid sequence at least about 90% identical to SEQ ID NO:19. In some embodiments, the isolated human ZNRF3 polypeptides have an amino acid sequence at least about 92% identical to SEQ ID NO:19. In some embodiments, the isolated human ZNRF3 polypeptides have an amino acid sequence at least about 94% identical to SEQ ID NO:19. In some embodiments, the isolated human ZNRF3 polypeptides have an amino acid sequence at least about 96% identical to SEQ ID NO:19. In some embodiments, the isolated human ZNRF3 polypeptides have an amino acid sequence at least about 98% identical to SEQ ID NO:19.

In some embodiments, the amino acid sequence of the isolated human ZNRF3 polypeptide comprises SEQ ID NO:18. In some embodiments, the amino acid sequence of the isolated human ZNRF3 polypeptide consists of SEQ ID NO:18. In some embodiments, the amino acid sequence of the isolated human ZNRF3 polypeptide comprises SEQ ID NO:19. In some embodiments, the amino acid sequence of the isolated human ZNRF3 polypeptide consists of SEQ ID NO:19.

In some embodiments, the isolated polypeptides comprise or consist of at least about 15, at least about 20, at least about 25, at least about 30, at least about 35, at least about 40, at least about 45, at least about 50, at least about 60, at least about 70, at least about 80, at least about 90, at least about 100, at least about 150, at least about 200, at least about 250, at least about 300, at least about 350, at least about 400, at least about 450, at least about 500, at least about 550, or at least about 600 contiguous amino acids of any of the ZNRF3 polypeptides disclosed herein.

In some embodiments, the isolated polypeptides comprise or consist of an amino acid sequence at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% identical to at least about 8, at least about 10, at least about 15, at least about 20, at least about 25, at least about 30, at least about 35, at least about 40, at least about 45, at least about 50, at least about 60, at least about 70, at least about 80, at least about 90, at least about 100, at least about 150, at least about 200, at least about 250, at least about 300, at least about 350, at least about 400, at least about 450, at least about 500, at least about 550, or at least about 600 contiguous amino acids of any of the ZNRF3 polypeptides disclosed herein. In some embodiments, the isolated polypeptides comprise or consist of an amino acid sequence at least about 90%, at least about 91%, at least about 92%, at least about 93%, at least about 94%, at least about 95%, at least about 96%, at least about 97%, at least about 98%, at least about 99%, or 100% identical to at least about 8, at least about 10, at least about 15, at least about 20, at least about 25, at least about 30, at least about 35, at least about 40, at least about 45, at least about 50, at least about 60, at least about 70, at least about 80, at least about 90, at least about 100, at least about 150, at least about 200, at least about 250, at least about 300, at least about 350, at least about 400, at least about 450, at least about 500, at least about 550, or at least about 600 contiguous amino acids of any of the ZNRF3 polypeptides disclosed herein.

In some embodiments, the isolated polypeptides comprise or consist of a nucleotide sequence according to SEQ ID NO:18 or SEQ ID NO:19. In some embodiments, the isolated polypeptides comprise a nucleotide sequence according to SEQ ID NO:18. In some embodiments, the isolated polypeptides comprise a nucleotide sequence according to SEQ ID NO:19. In some embodiments, the isolated polypeptides consist of a nucleotide sequence according to SEQ ID NO:18. In some embodiments, the isolated polypeptides consist of a nucleotide sequence according to SEQ ID NO:19.

The isolated polypeptides disclosed herein can comprise an amino acid sequence of a naturally occurring ZNRF3 polypeptide, or can comprise a non-naturally occurring sequence. In some embodiments, the naturally occurring sequence can differ from the non-naturally occurring sequence due to conservative amino acid substitutions. For example, the sequence can be identical with the exception of conservative amino acid substitutions.

In some embodiments, the isolated polypeptides comprise non-natural or modified amino acids or peptide analogs. For example, there are numerous D-amino acids or amino acids which have a different functional substituent than the naturally occurring amino acids.

The present disclosure also provides nucleic acid molecules encoding any of the polypeptides disclosed herein. This includes all degenerate sequences related to a specific polypeptide sequence (i.e., all nucleic acids having a sequence that encodes one particular polypeptide sequence as well as all nucleic acids, including degenerate nucleic acids, encoding the disclosed variants and derivatives of the protein sequences). Thus, while each particular nucleic acid sequence may not be written out herein, each and every sequence is in fact disclosed and described herein through the disclosed polypeptide sequences.

The present disclosure also provides compositions comprising any one or more of the nucleic acid molecules and/or any one or more of the polypeptides disclosed herein. In some embodiments, the compositions comprise a carrier. Examples of carriers include, but are not limited to, poly (lactic acid) (PLA) microspheres, poly(D,L-lactic-coglycolic-acid) (PLGA) microspheres, liposomes, micelles, inverse micelles, lipid cochleates, and lipid microtubules.

The present disclosure also provides methods of producing any of the ZNRF3 polypeptides or fragments thereof disclosed herein. Such ZNRF3 polypeptides or fragments thereof can be produced by any suitable method.

The present disclosure also provides cells comprising any one or more of the nucleic acid molecules and/or any one or more of the polypeptides disclosed herein. The cells can be in vitro, ex vivo, or in vivo. Nucleic acid molecules can be linked to a promoter and other regulatory sequences so they are expressed to produce an encoded protein.

In some embodiments, the cell is a totipotent cell or a pluripotent cell such as, for example, an embryonic stem (ES) cell such as a rodent ES cell, a mouse ES cell, or a rat ES cell. In some embodiments, the cell is a primary somatic cell, or a cell that is not a primary somatic cell. The cell can be from any source. For example, the cell can be a eukaryotic cell, an animal cell, a plant cell, or a fungal (such as, for example, yeast) cell. Such cells can be fish cells or bird cells, or such cells can be mammalian cells, such as human cells, non-human mammalian cells, rodent cells, mouse cells or rat cells. Mammals include, but are not limited to, humans, non-human primates, monkeys, apes, cats dogs, horses, bulls, deer, bison, sheep, rodents (such as, for example, mice, rats, hamsters, guinea pigs), livestock (such as, for example, bovine species such as cows, steer, etc.; ovine species such as sheep, goats, etc.; and porcine species such as pigs and boars). The term "non-human animal" excludes humans.

The nucleotide and amino acid sequences listed in the accompanying sequence listing are shown using standard letter abbreviations for nucleotide bases, and three-letter code for amino acids. The nucleotide sequences follow the standard convention of beginning at the 5' end of the sequence and proceeding forward (i.e., from left to right in each line) to the 3' end. Only one strand of each nucleotide sequence is shown, but the complementary strand is understood to be included by any reference to the displayed strand. The amino acid sequence follows the standard convention of beginning at the amino terminus of the sequence and proceeding forward (i.e., from left to right in each line) to the carboxy terminus.

The present disclosure also provides therapeutic agents that treat or inhibit decreased bone mineral density for use in the treatment of decreased bone mineral density (or for use in the preparation of a medicament for treating decreased bone mineral density) in a human subject, wherein the human subject has any of the genomic nucleic acid molecules, mRNA molecules, and/or cDNA molecules encoding a human ZNRF3 polypeptide described herein. The therapeutic agents that treat or inhibit decreased bone mineral density can be any of the therapeutic agents that treat or inhibit decreased bone mineral density described herein.

In some embodiments, the human subject has: a genomic nucleic acid molecule having a nucleotide sequence encoding a human ZNRF3 polypeptide, wherein the nucleotide sequence lacks a guanine at a position corresponding to position 167,122 according to SEQ ID NO:1, or the complement thereof; an mRNA molecule having a nucleotide sequence encoding a human ZNRF3 polypeptide, wherein the nucleotide sequence lacks a guanine at a position corresponding to position 2,707 according to SEQ ID NO:4, or the complement thereof, or lacks a guanine at a position corresponding to position 2,397 according to SEQ ID NO:5, or the complement thereof; a cDNA molecule having a nucleotide sequence encoding a human ZNRF3 polypeptide, wherein the nucleotide sequence lacks a guanine at a position corresponding to position 2,707 according to SEQ ID NO:10, or the complement thereof, or lacks a guanine at a position corresponding to position 2,397 according to SEQ ID NO:11, or the complement thereof; or a ZNRF3 polypeptide that comprises a sequence according to SEQ ID NO:18 or SEQ ID NO:19.

In some embodiments, the human subject has: a genomic nucleic acid molecule having a nucleotide sequence encoding a human ZNRF3 polypeptide, wherein the nucleotide sequence comprises a guanine at a position corresponding to position 166,500 according to SEQ ID NO:3, or the complement thereof; an mRNA molecule having a nucleotide sequence encoding a human ZNRF3 polypeptide, wherein the nucleotide sequence comprises a guanine at a position corresponding to position 2,085 according to SEQ ID NO:8, or the complement thereof, or at a position corresponding to position 1,175 according to SEQ ID NO:9, or the complement thereof; a cDNA molecule having a nucleotide sequence encoding a human ZNRF3 polypeptide, wherein the nucleotide sequence comprises a guanine at a position corresponding to position 2,085 according to SEQ ID NO:14, or the complement thereof, or at a position corresponding to position 1,175 according to SEQ ID NO:15, or the complement thereof; or a ZNRF3 polypeptide that comprises an arginine at the position corresponding to position 637 according to SEQ ID NO:20, or at a position corresponding to position 537 according to SEQ ID NO:21.

The present disclosure also provides ZNRF3 inhibitors for use in the treatment of decreased bone mineral density (or for use in the preparation of a medicament for treating decreased bone mineral density) in a human subject, wherein the human subject has any of the genomic nucleic acid molecules, mRNA molecules, and/or cDNA molecules encoding a human ZNRF3 polypeptide described herein. The ZNRF3 inhibitors can be any of the ZNRF3 inhibitors described herein.

In some embodiments, the human subject has: a genomic nucleic acid molecule having a nucleotide sequence encoding a human ZNRF3 polypeptide, wherein the nucleotide sequence lacks a guanine at a position corresponding to position 167,122 according to SEQ ID NO:1, or the complement thereof; an mRNA molecule having a nucleotide sequence encoding a human ZNRF3 polypeptide, wherein the nucleotide sequence lacks a guanine at a position corresponding to position 2,707 according to SEQ ID NO:4, or the complement thereof, or lacks a guanine at a position corresponding to position 2,397 according to SEQ ID NO:5, or the complement thereof; a cDNA molecule having a nucleotide sequence encoding a human ZNRF3 polypeptide, wherein the nucleotide sequence lacks a guanine at a position corresponding to position 2,707 according to SEQ ID NO:10, or the complement thereof, or lacks a guanine at a position corresponding to position 2,397 according to SEQ ID NO:11, or the complement thereof; or a ZNRF3 polypeptide that comprises a sequence according to SEQ ID NO:18 or SEQ ID NO:19.

In some embodiments, the human subject has: a genomic nucleic acid molecule having a nucleotide sequence encoding a human ZNRF3 polypeptide, wherein the nucleotide sequence comprises a guanine at a position corresponding to position 166,500 according to SEQ ID NO:3, or the complement thereof; an mRNA molecule having a nucleotide sequence encoding a human ZNRF3 polypeptide, wherein the nucleotide sequence comprises a guanine at a position corresponding to position 2,085 according to SEQ ID NO:8, or the complement thereof, or at a position corresponding to position 1,175 according to SEQ ID NO:9, or the complement thereof; a cDNA molecule having a nucleotide sequence encoding a human ZNRF3 polypeptide, wherein the nucleotide sequence comprises a guanine at a position corresponding to position 2,085 according to SEQ ID NO:14, or the complement thereof, or at a position corresponding to position 1,175 according to SEQ ID NO:15, or the complement thereof; or a ZNRF3 polypeptide that comprises an arginine at the position corresponding to position 637 according to SEQ ID NO:20, or at a position corresponding to position 537 according to SEQ ID NO:21.

All patent documents, websites, other publications, accession numbers and the like cited above or below are incorporated by reference in their entirety for all purposes to the same extent as if each individual item were specifically and individually indicated to be so incorporated by reference. If different versions of a sequence are associated with an accession number at different times, the version associated with the accession number at the effective filing date of this application is meant. The effective filing date means the earlier of the actual filing date or filing date of a priority application referring to the accession number if applicable. Likewise, if different versions of a publication, website or the like are published at different times, the version most recently published at the effective filing date of the application is meant unless otherwise indicated. Any feature, step, element, embodiment, or aspect of the present disclosure can be used in combination with any other feature, step, element, embodiment, or aspect unless specifically indicated otherwise. Although the present disclosure has been described in some detail by way of illustration and example for purposes of clarity and understanding, it will be apparent that certain changes and modifications may be practiced within the scope of the appended claims.

The following examples are provided to describe the embodiments in greater detail. They are intended to illustrate, not to limit, the claimed embodiments. The following examples provide those of ordinary skill in the art with a disclosure and description of how the compounds, compositions, articles, devices and/or methods described herein are made and evaluated, and are intended to be purely exemplary and are not intended to limit the scope of any claims. Efforts have been made to ensure accuracy with respect to numbers (such as, for example, amounts, temperature, etc.), but some errors and deviations may be accounted for. Unless indicated otherwise, parts are parts by weight, temperature is in ° C. or is at ambient temperature, and pressure is at or near atmospheric.

EXAMPLES

Example 1: A Highly Drifted Frameshift Variant in ZNRF3 Associated with Increased DXA Bone Mineral Density (BMD) and Replicated by Heel U/S BMD in Independent Sample of Participants Association analyses were performed using linear mixed models (MMAP; see world wide web at "mmap.github.io/"). An additive model was performed adjusting for the following covariates: age, age$^2$, sex, and study. The ZNRF3 frameshift variant, p.Ser844fs/p.Ser744fs, is highly drifted with an allele frequency of 0.022 in the Old Order Amish and is not found in gnomAD. Results are shown in Table 1.

TABLE 1

Association of a ZNRF3 Frameshift Variant With Increased DXA Bone Mineral Density (BMD)

| Variant | Phenotype | P-Value | Effect SD Units* | Clinical Effect | Ref/Het/Hom | AAF |
|---|---|---|---|---|---|---|
| 22:29050707:GC:G ZNRF3 p.Ser844fs: p.Ser744fs | Whole Body BMD (DXA) | 9.94e−5 | 0.677 | 0.074 g/cm$^2$ | 688/39/0 | 0.027 |

Individuals assessed for BMD by DXA and tested in Table 1 were excluded from this analysis. Association analyses were performed using linear mixed models (MMAP; see world wide web at "mmap.github.io/"). An additive model was performed adjusting for the following covariates: age, age$^2$, sex, and study. Results are shown in Table 2.

TABLE 2

Replication of association in a non-overlapping set of Amish samples for heel BMD

| Variant | Phenotype | P-Value | Effect SD* Units | Clinical Effect | Ref/Het/Hom | AAF |
|---|---|---|---|---|---|---|
| 22:29050707:GC:G ZNRF3 p.Ser844fs: p.Ser744fs | BMD (Heel U/S) | 0.023 | 0.251 | 0.036 g/cm$^2$ | 4206/104/0 | 0.024 |
| | BMD T-Score (Heel U/S) | 0.046 | 0.271 | 0.316 SD units | 4010/98/0 | 0.024 |

Imputation was performed on the chip data. Association analyses were performed only on European ancestry individuals using linear regression. An additive model was performed adjusting for the following covariates: age, sex, site, array, and the first 4 principal components. Results are shown in Table 3.

TABLE 3

A Missense Variant in ZNRF3 Shows Suggestive Associations in UKB 500K Imputed Data with Increased Bone Mineral Density & Bone Mineral Content

|  | Phenotype/Trait | P-Value | Effect SD Units* | Ref/Het/Hom | AAF |
|---|---|---|---|---|---|
| ZNRF3 22:29050091:A:G p.His637Arg, p.His537Arg | Leg BMD mean | 2.81e−4 | 0.576 | 4130/31/1 | 0.005 |
|  | Leg bone mineral content (BMC) log10 | 4.55e−4 | 0.556 | 4130/31/1 | 0.005 |
|  | Arm BMC log10 | 6.34e−4 | 0.541 | 4130/31/1 | 0.005 |
|  | Femur neck BMD log10 | 7.79e−4 | 0.462 | 4898/43/1 | 0.005 |
|  | Total BMD | 8.50-4 | 0.463 | 4894/42/1 | 0.005 |
|  | Total BMD T-score | 8.66e−4 | 0.462 | 4865/42/1 | 0.005 |
|  | Femur wards BMD log10 | 9.26e−4 | 0.455 | 4901/43/1 | 0.005 |
|  | Total BMC log10 | 0.001 | 0.450 | 4894/42/1 | 0.005 |

Example 2: Assessing BMI in Knockout Mice

Figure 2:
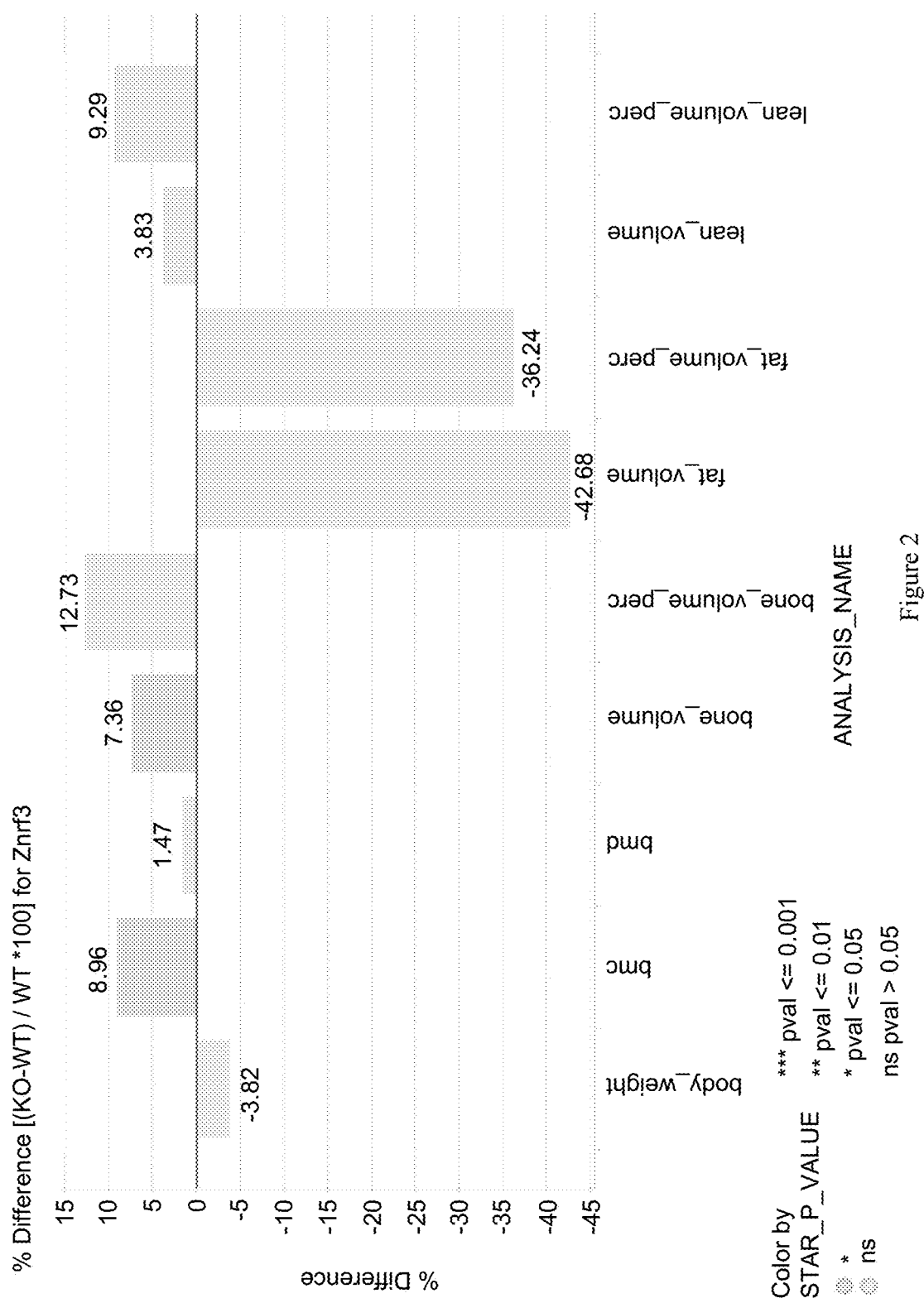
FIG. 2 shows that Znrf3 heterozygous null mice have increased bone mineral content and increased bone volume.
Figure 3A:
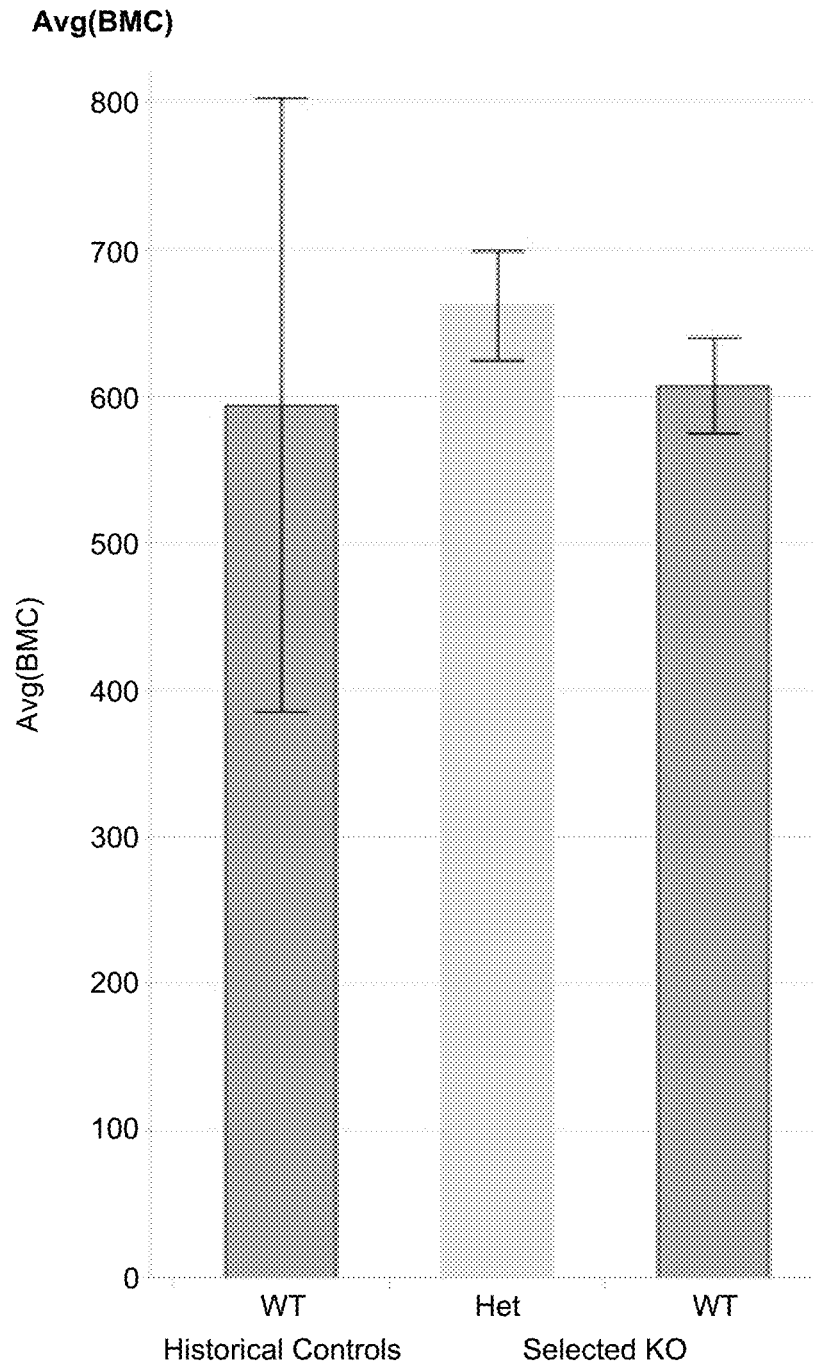
FIG. 3A shows that Znrf3 heterozygous null mice have increased bone mineral content.
Figure 3B:
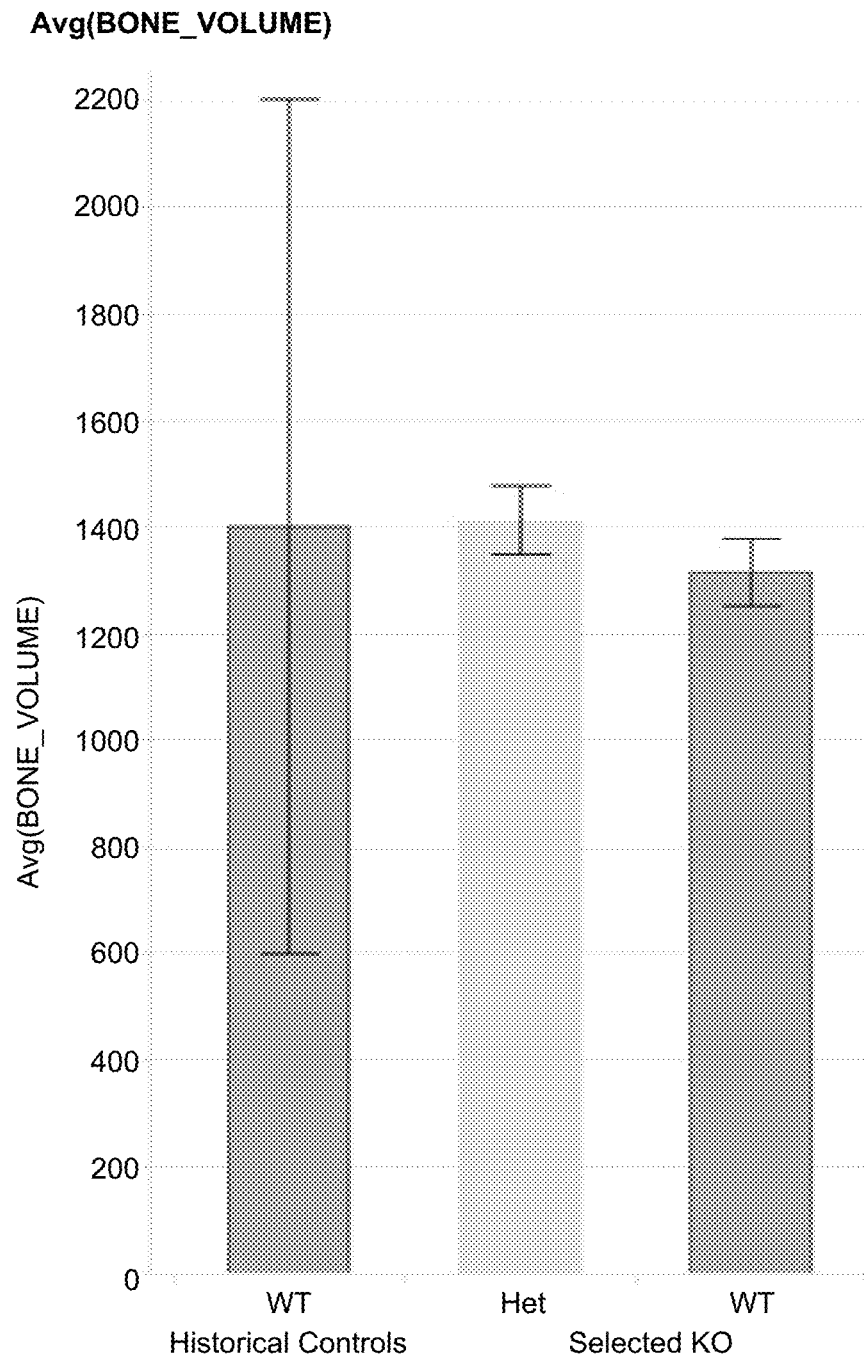
FIG. 3B shows that Znrf3 heterozygous null mice have increased bone volume.
Figure 4:
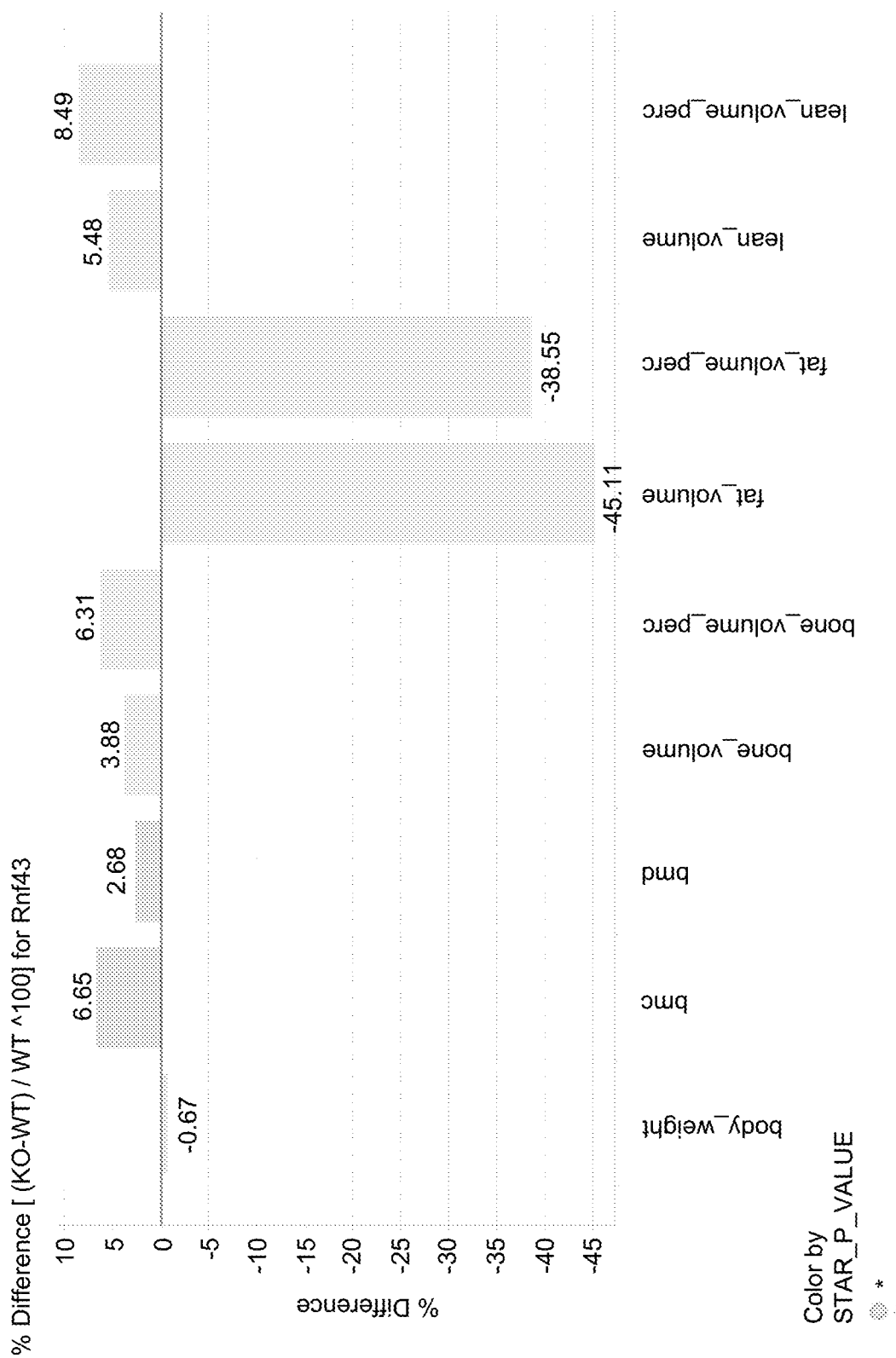
FIG. 4 shows that Rnf43 null mice have increased bone mineral content and increased bone volume.
Figure 5A:
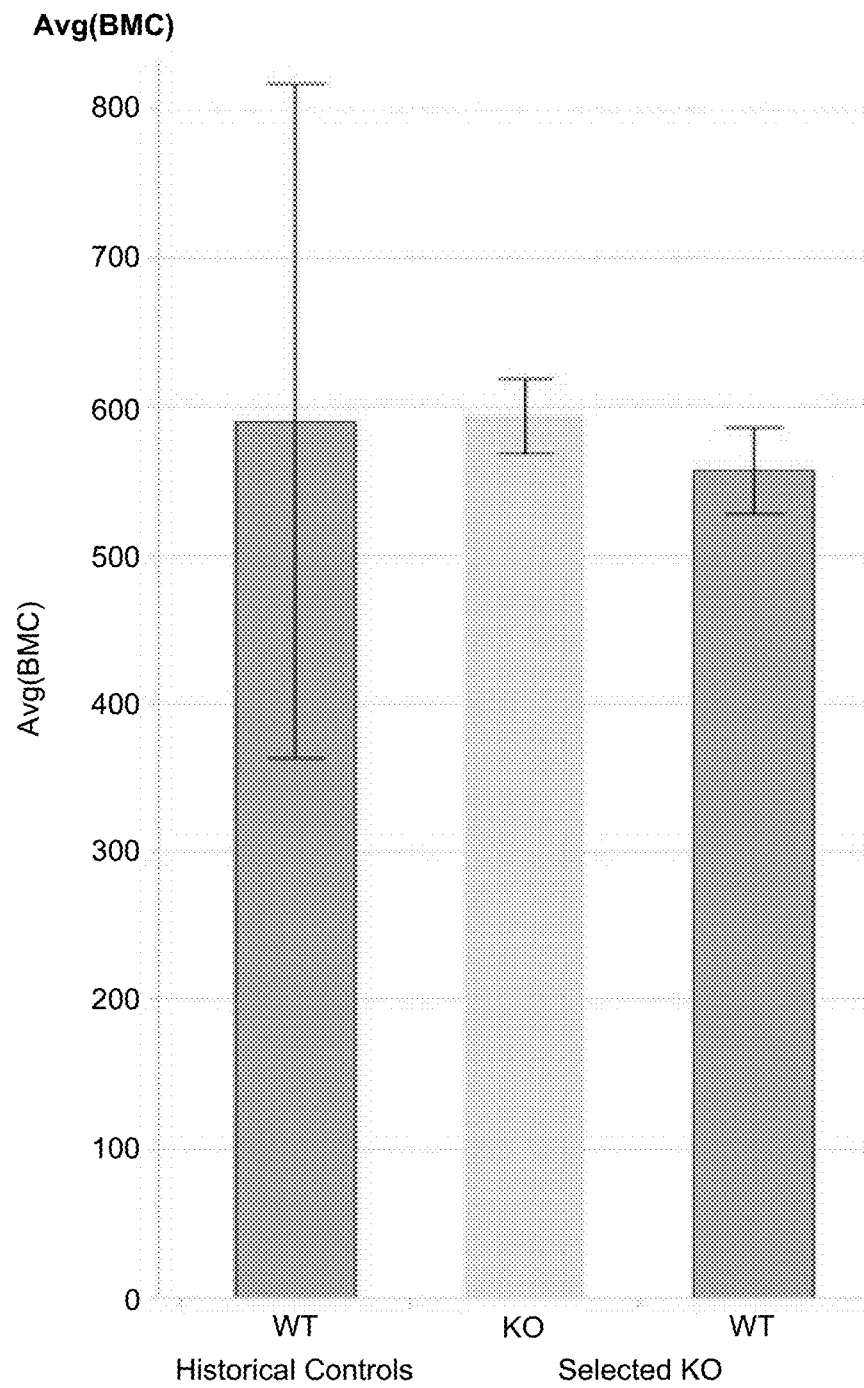
FIG. 5A shows that Rnf43 null mice have increased bone mineral content.
Figure 5B:
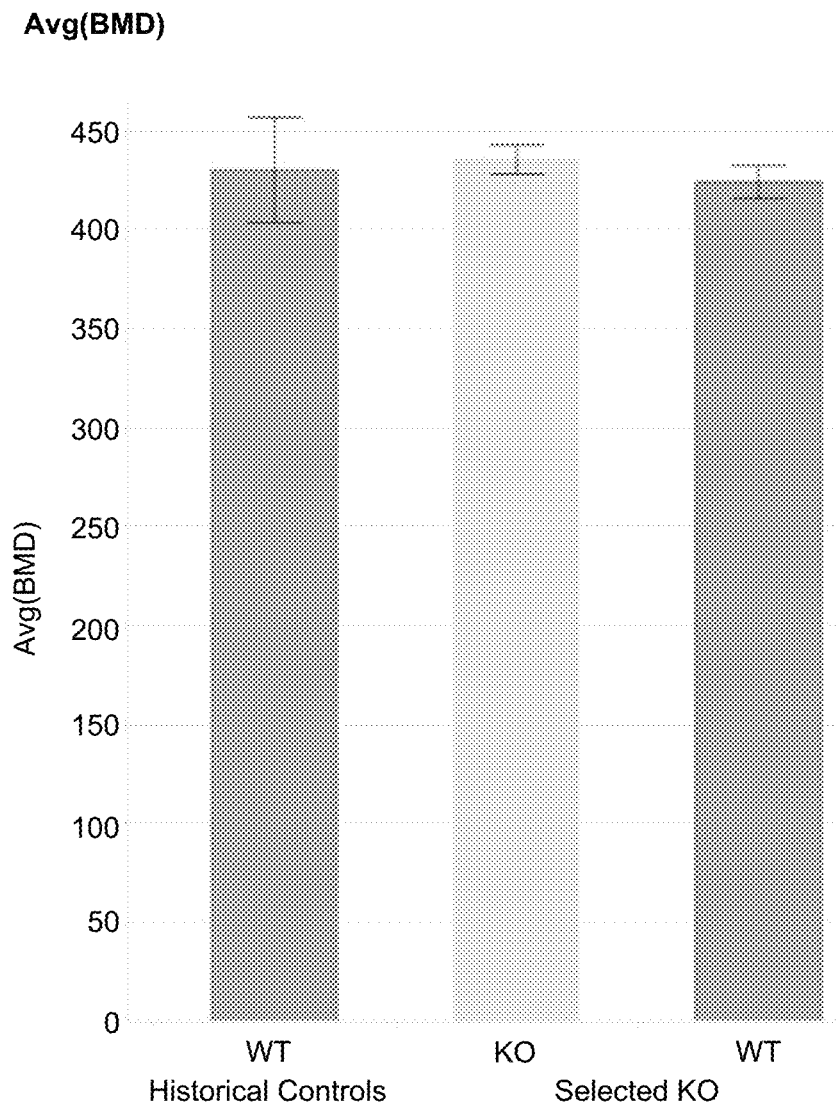
FIG. 5B shows that Rnf43 null mice have increased bone volume.

Bone mineral content (BMC) and bone volume were assessed in heterozygous Znrf3 null mice. The results show that heterozygous Znrf3 null mice have increased BMC (p=0.02, % difference=8.96) and increased bone volume (p=0.02, % difference=7.36) compared to their wildtype littermates (FIGS. 2, 3A and 3B). BMC and bone volume were also assessed in Rnf43 null mice. The results show that Rnf43 null mice have increased BMC (p=0.0387, % difference=6.65) and increased bone volume (p=0.0307, % difference=2.68) compared to their wildtype littermates (FIGS. 4, 5A and 5B).

Various modifications of the described subject matter, in addition to those described herein, will be apparent to those skilled in the art from the foregoing description. Such modifications are also intended to fall within the scope of the appended claims. Each reference (including, but not limited to, journal articles, U.S. and non-U.S. patents, patent application publications, international patent application publications, gene bank accession numbers, and the like) cited in the present application is incorporated herein by reference in its entirety and for all purposes.

SEQUENCE LISTING (39 sequences)

SEQ ID NO: 1 - DNA, 173896 bp, homo sapien
agatgaaagggccgcggcgcgacggccgggggagccgagctgagcctgcgacccacaaagccgccgccgccgccgccgtgatggggctgtgaggcgtccgcccgcgttcggtcctcagccggcccgcgactatgcccggccgcgcccgccctccgcgccctcccgccgcaggaccatgaggccgcgctcgggcgggcgcccaggggccacgggccgccgccgccgccgcctgcgccgccgcccccgcggcctccggtgcagccgcctgccgccgccgccgccgctgccgctgctgctcgggctgctgctggcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcaggtagctgcccgccgcccgggccccgcgccgcctccgccacaagatggctccgggggctgcgcccgccgaccccgccgcgggctgcctgactggcgggcgggcgggaggggtggccgagaggccggcggcatccctcccctgcgggcgggcaggcgggcgggacgcggcctccggggcgcatccgcggggggcgagcgcacgtgggggctagagctcctgtgaaccccggggcgggaggggcatcctgggcccggcacccatgctggggcagcccccttggccggttgggtatttaggtctgcctcaggtggaagtcccgggaactacctgttgaatgccaactttgaaaagacaagtgatgagggatggggtggctcgtttcaggttgcaggctttgcttttccatccatgcatgttctttttgggtgcggccaggtttgtctgaagggctgcacaacgtcgggttcttccccggaacctgccgtccgcctcacctgggcgccggtgacccttctgcggggctctggacaagcagcagcaggcaggggaggaggcggagctggtcgaggagtggggatcgggggttccctggagtggcgatggaaggcagccctcgctgcatgcttcacattacagagggtgggagggataccgcctgcccgtccctcggccaaagactgatgcgaaggacctgcaaatggggagatggcgtatctcactgacaggacctccaccttggaccaaatgaaagagatctacattccaaaggaaactggctagggagacctttaagccgtgcctactctttggaggagggactctcaactgaagcttctgcggatggttagctgggtggatgtcttcccgcttccttggccgtgattttatcaacttgttactagacagccagcgcactaataatggcagttaatatgcgcgcctcggatgggggcgattcgtaaaggttggcttgtctttgaatctttggggtgatcggatgtctgcagggcctaagctttgtgggccttctgtgctttactcttgggtgagttatgaatgaaaagaaggggactccatggaatgattgcatagcagcccgcagcgtagacagcctgttccgtggtgtccttttccttccttgggtgcagactcaaagccctgccttcataggacagggagagctgtgcagcttgactccgtagaggtgtgcccttacaaagctggaggaggtacccaggcccatgcgattaatcagcagcattgccttaccgggctcttatccccatccgaaaacttctgtagggtaaatagaagaggaaactccttcattgagccctttgactatctatgttaatgcttttggacttaaaaaaagttgtaattatgatctttataagttttagagatgatgctttgctgaagattcctaaacatttaagtcttgctccttggcaacttcttgtctttctttgaggctttcattgtgtcctgatggttttagaaatgtttgatttacagccttctaaaaaaaaaaaaaaaaaaaaaaaagacgctctagcgtggcacttgactttttgaaggagacttttgaagtttgcagtttttatctgcaatgttttaacgtgtcactctttctcaacagtagtttgtctggtgagcgagctatccattatgaggagtgttatgctttggagataatcttgggttcaccatttaatacaaaattagcagtttaaacaccatttgtaactattttatccttgtgagtagagagataatatgtgaatttggcagaaggaatctattctcttctgaaactttttgaagtgcttatctaactcttttgtagtccattagcctagccaaaaaaaaaaaaaagtcaatagttgctaagtaaagtgacttaaatggtatttaataagtttacttgttaagcaatcactaataggtgtccttaattcccttatagctgcagtaatgttggtgagtttatctgagctgtctgaatagtcatttcatggtgcacctcgtatctttagtaactttattgtggtagctgacttgttgaacctccctgtttctgcggacagagtgcagtgtggctttcagggatgtgtgtgtacaaaggctagcatgcttttatgagttctgcaaatactgtttgattgaaggaattggtgtggaccttgtctggcagccctgaaaaagttttttgtaaggaaggctgatgatgttttagggccgctgagagggaatataacattttcttttggtgagaaatgagaaagcagaaggaataaattgctgtccagctttggattaatcatgttttctaagtaacctgaacttttcaaaacctccttttatttactgtctttaaataaacctccttttgtttactatcttgaaaaacctttataagctttagagatgatgctatgctgaagattcccaaacattttatccacagtcttcaagaatagtttgaatcttaactcttgctcattgtaacttcttgtctttctttgaggctttcactgtgccctggtgacacagtctcattgaacttttcaaaacttccttttatttactatcttaaaagaaaatagtagccaggcatggtgactgacgcctgtagtctcagcattttgggaggctgaggcaggaggattgcttgagcctaggagttcgagaccagcctgggcaacacagttagacctggtctctacaaaaaaaaaaagtagcccagtatggtggtgtgcacctgtagtcccagctatttgggaggctgaggtgggaggattgcttgagcctgggaggctgaggttgcagtgagccatgattacaccactgtactccagcctggacaacagagcgagacactctctcaaaaacaaacaaacaaacaaaaactgtgatttgctgcttagtgttttatcgtctcagagcagagttcattttcctataactaaagctaaatagtagcactatagcattgcttttgttatttccactggggttctgtagcagttttatttattcatggtttaggggagaaaaaacctgtttaggagtgtcacctttaagaattctaagataaggaattcgtttgtattactgatttttaacccccctccttattatatgccaacgaagagagagagagagagtgtgtgtgtgtgtgtgtgtgtgtgtgtgtgtgtgtatacatatatttgtatagtagataccttatcatagtctggtttgcctagataattctaactagagtacctgttcagtcatttccatgggttagggtaggggaagcctagttaagaattgtgtcagtttgtcagtgtcagagagagagagagagtgcaagagggagggaggtagtaattcaaaccttaggattcgtcatcaggaatcttggttcttctcctttgcgttttaggcttaaataactatcccaaggtcaccaatgtaatctgaatgaagaattttttttttaatgtctccatctgtgaaagttgtggtgaaaacaatttgtgggtatgaaatgctattagttacttttattatcttatgtatttatgcagtattaaagcctgtttgcttgtaagagtgtcaggcatacagtttgaatgctggagaaattaattacacttctcctgtagttctgaagtgtgggactttaaagggttcttagatatattgatacatatttcatctttgaaccaatttgttgctgttaatgagatcattatctgaaactttcagacttggctgtgcaactcacatggttggtgatgttaaataaaggcccgattaaacaccggctagtggtatgtggattggttaaacaaagaaaatttgcattgctagagatgaaagattgttttaaagtcgaaatgcattttttttttgcttgaagtcaaatatttagaaaagcttgagaaattcatttgtagaaggaatctgaatgacaggttctgtgtaactttaaattcagcctttctgggtcctaggttaaatgctgaatggacttgaaaacagagagaagctgaggacatttaagaactaagtcagttcctttagctattaggggtgggtagagagctgggtggtgggttaaaagggctgatcaaggtccttaaatatccgatgttaagtaaaggtatcacagagagtaattttaggaaactaattcctctgctttgtttccctgtcagtgtgcttctgcagtttagcatttgatcaaacactttcttttcatctccattttaagttaacttaacaggcctgcctctaaaaattgacttggtctaatagaacaattgtgtgctgacagctgacctggatttagacagaaagggattgcctactgtcttctcagatgggccttcataggttaaaaccaagcatttgattcagggggaaaactggggctgtattttgtgatgttatacattcttagagccccttattttctgttttgttccctgagatctcatgggagttactagtacaattctgaataggaatgaaattggagttcagtgtagagctgtagattaaagggaaagtagtgatggtttcctcttatttatacagagcactgccaagcatgtcatgttttggttcttctcatcctgacactaacatgcaattagcaactattgttaatccattttacagaggagaaaaactgaggctgagagaagcaagttgagttctctaacttcacatggctagcagatgacaaacctggattgaaacccaggtctggccgggcgcggtggctcacgcctgtaatcccagcactttgggaggtcgaggcgggtggatcacaaggtcaggagttcgagaccagcctggccaatatggtgaaaccatacaaaaaaaatacaaaaaaaattagccaggtgtggtggcacatgcctgtaatcccagctactcaggaggctgaggcaggagaattgcttgaatccgggaggcggaggttgcagtgagctgagatcacaccactgcactccggcttgggtgacagagcgagaccccgtctcaaaaaaaaaagaaacccaggtctgcctgggttgcttgttcttgtttttgccaagtgaacagaacttggctggttaggattttgacattaattcaagtctaattttgaacaacatataatataggggttcttaacctgagggtcacagactttcagagatagtccatgaactcctgcaagtgtatgcgtattcttgtctatgggcagttacaactttgcctcttccagggttctgtgatgtgtcccctctatacccacaaggaaaaggggaaactctaatctagtagagcattgaataatccattaccaagagtttgagtggggttcaggctgacaagagttgtacggaagtctacaggtctgggtgcctccattgaacatatttattttgtagacatctatcacagccctattctgtaccagacactgtattgctgttgtcttctggagttcagtctcctatggagacagacacatgcatggataaatgataattcttaccaaatgggtttctccaccgaactgagcccttaggccctgaggcatccattgtctataatgaattaacttccctcctgtgcactgcgcagcatccttgggagaagagagaatatagtcactcaaagacttttctgcatttacatggcaaagtgtaagaacttgacactctgaatgcaggatgtgggaaagcagagtatagttccgtttcatagttcattgaaaaatgaaacggagcacctgtcgctgttgaaatgcctgaagagtagcttctcacaccttcccttgtggacctggaccccatggggtctgtttttgctcatttctggatcgaccccctgggttcccactgcctgctatgcatgaggcactcagtattgaatgaataaatgatggagagtggacatcaggcaggcagtgggttttatggattatttatgctttaattgatgagaacaacttgctttggcttggctaataaattctgggattatccttcctttttgattgttatttccagaaacttgcttggatggaaaggatagctctctctctggttcccatagacccactggtattacaatactgggttgtatgaaagtgatctggcccggtgtggtggctcacgcctgtaatcccaacactttgggaagccgaggcgggcagatcacaaggtcaggagatcgagacaatcctggctgacacggtgaaaccctgtctctaccaaaaatataaaaaattagccgggcgtggtggcgggggcctgtagtcccagctactggggagactgaggcaggagaatggcgtgaacccaggaggtggaggttacagtaagccgagatcacgccactgcactccagcctgagcgacagagcaagactccgtctcaaaataaaaaaaataaaaagaaatctgtgtggggtgtttatattccaaggcagggtacctggcataagaaaagtctgaaggtgttcttttcctgatgaaactgagtattgacaaagccttaaagtggataggttatggaaggaaagaatcttgaatttccagtgtccctgggagtaacaataagggattggcattcagtatcatcgttaacctaaatatatgccatgtgaaaaactttgctgcttgcttgctttctctctctctctctttttttttttgtcagggtctcaccatgttgcccaggctagagcacagtggtaagatcatggctcagtgtactcttggactcctgggctcaggcagttctcaggcctcagcttccccagttgctagaattacaggtgtatgccaccataccgagctaattttttattttttgtaggtatagggtctcgttatgttgcctaggccggtcttgcactcctggcctcaagtgatcctcctgccttggcctcccagtgctctgggattacaggtgagagccaccatatctggtcagaactttgcttcttgatggtattttcccaagtctggagagtttggatttctaatttgtgacatttaagtaaatcttcataatcaaaagaaccagattcagtcctttaatgtgttagaaaggagactgaaatccagagaaatgctttgctgaagtccacataaggtagagatgacccaggattaatatttgggtcccctgactcccaggcttggagcccttctgttacccccggctgtagcctggctgagtgtgacaggggacaccagatgcagggcatgctttatgatcagatgtataattgaggaaagccaggcattcttaaattgtatattgggtttaagtggttgcttttcttctctaattaatttagattttgagtctctcagtcttcctccctgtcagagcttttaaaaatagctactaatgatcaagtgcttattgtgtgccaggcactgggcacagtgctttgctcacatttaacagacaaggtagatggcatgtgccagagaggtaaagtcacttgtcaaagtcactgagcaagtcattagtgcagctgaggttcaaatcctggtctgtctgattctaagccatttctgttttcacaagcccgcttcacttcacactttcttatgatgaggttatgggaactgatgtggaatttagagttgagtttaaacccaaaacgattgaccaagaaataagtctataacgtcaactgagaaaatcccctatcctcacaaagatgtatttccttcctttcttttcctcttctttttttaaatcacaaaagtctcattctaacttagttttttccataaagagccaatctaccaggttcacaaagagggaccagtgacttgacatatataactgtcactcgatggcacttctgttgttttcagctattgggcaagctggaatggctgtagttttctggcatttaaagggatttctggtgtgagacacacctccttcctgtggctgacttttatagcaatttgggagtctgcatgtctttctccaaagaggtcacgtcccatgtttgtgacctttcttactttgcacaggctcattgaatcctcttggttgttaaaacttaccacgagtgctacatgcctcagtgggcaaacattcagtggtgccccccgtccatcagatcctttgtggggcaaggcaatgaacacaagagtaagacttggtccctgcctgcaggcagctgagtgtaggtgtccagacagcacacgaacggttaccttacagtacagtggggcatgtcctatctggtaggaaacagcctataggatactgaagaacacctgggggagggaatcgggccctggtgctaagtttagacctgtctgtcactgtatgagcattctggccttttccaactcatttttacctacctttgaggttaaagctgataacctctttgaagagaggtgcctttatacctttctaacggaataggaaggaggtagagagtagaggttctttgttctatttgtagcttgaatgagatgttttaaaatctgactttcagtggctctgtttactcatgatagtgtcaaaagaataaggtcagctggcccattgtggttcaaaggagagcactttatttttattgcccttaagatgtgttgtaagacttgatattaatttcctcctctccccagcagccagtgtaatatagttgtttagaaactcagtatagagtttgattctgtgaaaacgaagtttgatcctagaattttgatgggaaaacgtatgttagaatggggacttctggcctcctggtgcagaagtgcctgcatttaaaaaataaaagagccggcgcggtggctcatgcctgtaatcccagcactttgggaggctgaggcgggcagatcacgaggtcaggagatcgagaccaccctgactaacacagtgaaaccccgtctctactaaagatacaaaaaattagccaggcgtggtggcgggcgcctgtagtcccagctactcgggaggctgaggcaggagaatggtgtgaacccggcaggtggagcttgcagtgagccgagatcacaccactgcactccagcctgagcgactgagcgagactctgtctcaaaaaaaataaaaaaataaaaaataaaattaagagtggggtagtactcaattaggtgtgtgtaagttcccatccagcactgtaagaattttattataacttaattttctacttgagttaatttggctttgctatcttgtcagcaaacatttattgaatgtttactgtagataccgtatagagaagaaacatcggttttatgcacccgtggtataatttgtgcttttcaaatgttatttttctgatttattcgagagtttgaggctgcagtgagccttgcagctaccagtgtgagccaccgtgccagcattggtaattttctttctttctttttcttttttttttttttcgagacaagttctggctctatcgcccaggctggagtgcagtggcgtgatcttggctccctgcaacctctgcctcctgggctcaagccatcctcccacctcagtctcccgagtagctgggactacaggtgcacatcaccacatccagctaatgtttgtattttctgtagagatggggtttccccatgttgctcaggctggtcttgaacttgggagctcaagcaattcacccgccttggcctcccaaagtgctgggattataggcgtgagccactgtgcccggcctgccttggttattttcataagatttctagaattaggttcactgagttaagtgatataaacatttttgaggcttttgctacatatttttagattgctctacaggagtggtctagtttatacacccctaccaggtcgccatgtatgtttctacacaatagccctgctcgcaacagatagtatattttgctctgttgcccaggctggagtgcagtggcgcaatctttcttggctcactgcagcttgaaatctcaggctcacaagtgatccttccgcctcagcctcccaagtaactgggactacaggcatgcaccaccatgcctggctaatttttttttttttttgtagagatgggtttttgccatattgccaaggttggtctcaaactccagggctcaagtgatccacccaccttggtctcccaaagtgctgagactataggcgtgagccactgtgacccactgtatgtttctcaaaaatacaaaatgtcgtaaaagtgaaagtctatatattcctatcatttagtaaatagtaaaatactggctttttttttttttttgtctgccataaggatctgaattatgactaatgtctgcactgaagggaaggtacctggcgtggcatctgggtgcctcccttgtaggtgtatcagagcatgattcaggagcagcaggttgcccttgtattctgggcaggaacacggcgtctgtccaggcagatggccatgctcagaggcctcacggtggggaccgctgtgctgtcgtcacaccctgtggcagcagattgttgcccaggagggtgctgcttcagttgctggtttctgcccttcctctttcctgtcgagcaggctttctgcttctgaacaggctggattcagaaaggccgaatgaatctgtccttgaattcatagtgacactgtcagttggtggtgggcagagatgcaagttgagcccaagcaccagactctcaggggtgcatttaagcagcaagcatataggctgaaaacagcttccaggtattttgttcgatcgctgttaaaaatctagaaagtgtacataaaaatgggctcttctaaaaaaaaaattaaaagatctggcatcagtgggtccacagtcccatgaggcaatagcctgccatagtggagtggcagctgccccccttcagcaggtacacaggccctccagtcacaagtccttatcgcattgcccagcttacttccctcactgacagttccatttacagatgcctggccctgtagacactgtagctggccatcctttctgtctctggaagttccaaagttgaaagcttttaacttgtgcttggcaagtctcttttctctccttccccaaccaacctgagtgtgagatgtccatcagtggaccccatgagtctcaagttatgctactgaggaaggcccagctacccttgatgtgaccagagggctctttttgctttggtgtaggtgttgaaggctgaagtctggagccattggcctgtgccttcaggatctttgctccttctctctttttggctccatggtttctcaactctgagacttaattgtttgtgctgaagggcaccttgaaaatgctgtgactccggccgggcacggtggctcacgcctgtaatcccagcactttgggaggctgaggcgggtggatcacgaggtcaggagatcgagaccacgatgaaaccccgtctctactaaaaatacaaaaaattagccaggcgcagtggcgggtgcctgtagtcccagctactcgggaggctgaggcaggagaatggcatgaacctgggtggcggagcttacagtgagccgagattgcgccactgcactccagcctgggcgacagagcgagactccgtctcaaaaaaaaagaaaatgctgtgacttagctctccttttgcagtgagggaactgtgggcaagggcatctagcctttggtcttaagagctgggattagaactcagaacttggggttctcgggggaggggtggtctttctagaatggcattctgctgcgatggttgaattccagaaaatcttccatgtgcctgttgctttagggttcctggtgtactttcacttacagtatcttagttcatcctctcatttgggagtgccttttctggattctgccccagaaggctgtctgctgttcaggtggtctgaggcggagtcttgctctgtcggccaggctggagtgcagtggagtgatcttggctcactgcaacctccccatcctgggttcaagcgattctcctgcttcagcctcccgagtaggtgggattacaggcgtccaccatcacgcccggctaatttttatttttatttatttttatttttatctttttgagacggagtctcgctctgtcggccaggctggagtgcagtggcgcgatcttggctcactgcaacctccgcctcccgggttcaagcgattctcctgcctcagcctcccgagtagctgggactacaggcgtgtgccaccacgcctggctaatttttgtatttttagtagagacagggtttcaccatgttggccaggatggtctcgatctcttgacctcgtgatccgcccgcctcggcctcccaaagtgctgggcttacaggtgtgagccaccacgcctggcccctatatttttagtagagacagggtttcgccatgttggccaggctggtctcaaactcctgacctcaagtgatctgtctgcctcagcctcccaaagtgttgggattacaggcgtgagccactgtgcccggcctgagaatgcttttctttgtacctaatttgtatacttttctttaaatgcatttgacattgtgtgtttagcacctttatgggatttctggaatatcgctgggtacctggagacttggcatcttttcagaaagtacatcagtcttggagtaggtggtgagcagacagctaatggcatgtaaagaatgttgcaagcttgacttgcaaagctatttcaaaatttaaataaaggtagcttgtggctgagttgaagggaaatggtggtatcttcaagacaatgcttggcttgctctgcctcttgctgacttccctcttcaggcctgatgctgcccaagctgtttccctgtctctcattctctctcttttggtttttctttttctttgtttttaaaagagaccaagtctcactatgttgcctagactggacttgaactcttgggctcaagcgatccttccgtctcagccttccgagtagctgggactatgcaggcatgtgccactgcagtcggctctcacattctctttcttcccatcagttcttcccttcccttcagattcatccttctaaagtagtgtttggtcacatcagtctcttgatcaaaatctttcgtggcgtcctgttgcttactactgagctgtgtgaagaggtgacctagctgccccagtctctcattgttgcctccgggcgtgggcctgtgtgttgctgtccttgttcctgagtgggtcctgggctttcctctctcagtgcttttctttcttttttagggggatcggggagacagaatctcactctgtcacccacccaggctggagtacagtgacgtgatctccgttcactgcaaactctgcctcacgggcttaagcagccctcctgccttagcctcttgagtagctgggaccacagaaatgcgccaccacgccctgctaatttttgtatttttagtagagacatggtttcaccatgttgcccaggctagtcttgaactcctgagctcaagcaatccacctgcctcaactcccaaagtgctgggattactggcgtgagccaccgcacctggcctgtgcctttccttttggattgcctgctgtaatacgtgtcttcacctccacattttcaactcccgtctttgctttccactgtctttttcctgtcctagctcctcccatctgcagccaaactttcagtccttcccatgaagctttttcctgggttccaccagtgtgttcctttgaatcagagcactccatctccctattgtcttggatgtaaaacatgtaaattatttaccgaaccggaattctcctagatcacactactttgggatagcatagtgagagggatgtgaaaggggtgttaatgtggcctgcagaaaaaaaggcttggctttttttctctttttttaggtggggtctcactctgtcacccaggttggagtgcagtggcacgatctcatctcactgcaacctccgcctcctagtctcaaacgatcctcccacctgagcctcctgagtagctggctgggaccacaggcacacaccaccacgcctggctaattttttgtatttttcgtagagagggggttttgctgtgttacccaggctgctcttggactcctaagctcgggtgatctatgcacctcggcctcccaaagtgctgggattacaggcgtgagccactgtgcccagccaagacttgtttttttgagggagaattttctgtgattgtcgcaactatttgcaagcagctttcagacatggtgtgtcctgattattccaaatagttgggatagtccagactctcaaaataatttcaccttgcctgtgcttcctggaggtctggagaaaggagacagtaggaggtgacaccctctggctccttccagtctggcgtgtgcctgccctgggaacattgttcagaacatgctggagaagagaatatcacagcctgactgtagacttttggggatgtgttttatttaaatatgtaaaatataatattttggtgtcacttaaaacaccgggacttttggaggcgtagtagaagttctatgtagcttcagaatgacccatcagaaacaaatgtatatgagtctttacttacatttgtgccatattgcttccccctatatttttttccctttggaagctctggcatgggccttgatcctgtgtttaagcgctgtgtgggaagcagaatttaaaaggactgtagtagtatttctaaagagacttaacaggctacatgtgagagaattttagatttcaatttagcaaacgtttgattttctagtctttatggggctgactgtaagcatttgggaaattattgaattattgcttagttctgtataagttgacatgctgaggttttttttttttttttttttttttaactgtttttgtgggacagtggtgattacatgggcattgggactttcaggaatattccagaatctatgatatgttgtatttcacttgtgctagagggttttcaggctgccttttcatggcatgttcactccagaaatgctctaatgcccatcaataaatgtcaccctcatcctaggaattagatgaagagattatagttttgaagttttggtgttattaggcttaaatctctaggacacatataaacacacttgtggtattaaatgtgccgggtgggtgatttcaagttccagtggcagtggtaatttttgcatttcctgactcttgtgtttaaatttgcagtctcaacattgcatcactgtaagttttcacatttaatgaatatttatgttgagccaagttctatacgaatgtggtggtttctgacttgattatagcttgctgtgtactgtggccaggagtgccctacagacaacagagttggcacacgtctcagcatgccaagccccggcggatgtggttagggaccacggtgactggggcattggttgccataccaaccttgtttttggaagggaaagctctgaaacagcaatgggatgggggcagaatagttttgaatattccaagtaaacttattccctatatgttccctgcaagaagatgctatagaaaactataattcttactatgtgctcagatagcatgagttaattttctttcttttcttctttctttctttcttttttttttttttttaagacagtctcattctgtcacccaggctaaagtgcagtggtatgatcttggctcactttagcctcgacctcctaggctcaaacgatcctcccacctcagcctcccaagtagctgggaccacaggcgtgcaccaccatgcccagctaattttgtttatgttttctagagatgaagtctcagtgtgttgcccaggctagtctcgaactcttgggctcaagcaatagttagtttacttttgcaaggctgttttaattgtccttttgcaaaggtgtggaagttatatggtgggcctttcatgtgtgaatttcttccctacttgttggagggtaaacaggggatcttctatctcttcctattacagaccttcttctctcaactcctgccaacctcccttgccctctggtaactaacctagtgatgactgattgggggagggagaagggaaagaaaaacaggaaggataaatgggggactcctcctcccccagctccttatttatattcctcactttcccttataccaagatggggtttccttgctcctccctattgtatataagcaaagatcacagtcgaaggtgccatcacccataagtgggatgttagggtgccctgctcacgagcttcggcagacagaactgggatgagaggaaggaaacatccctggcatctcacactggaatgctgttacctctttgcaaatggtgccttgcatgattaattctatggtacttggtattgtgcagtaaaatgtctggaagggaattgatcaagtctggtaagccagatcagagcccagaatggcagagtgggatgtgacttgcaggtggcatctgctgttctagtgcctctttacagaagatgatccaagtctctggaagctgccacctgtccaggttcaacagctcaggcagtctgttgttgtggagggcttgtcctcaagcctcatcacacaaaaaaagtaaaaaccccacccctttgaaaagaaacttactgtttcagaagagggaggcagtccaatgatttaatctttgcttgctgacttggagccaactccccattagattgtaacctccttccgggcagggttggtgtttcaatctatttaacatttttcagctgggtgcggtggcttacacctataataccagctttaggaggctgaggtgggatgatcgcttgaggccaggagtttaagaccagcttgggcgacatagcgagactgttcctacaacaaattttttttaaaaaaattagccaggtatggtggtgcacatctgtagtcttagccacttgggaggctgaggtgataggatcacttgagccctggaggttgaggctgcagtgagctgtggtagtgccactgcattccagcctgggtgacacagcgagacctgtctctacaaaaataaataaataaataaataatttttttttaaatgcagaaaacatttcccagttcaactcaaagagcctctttgtttgaatttggaagagctgtcccttcctgaagatacctgaattctattttctgctcatcggtcataatgtgaatctaggatgagcacagatgtgaacggcacctcctagagttgtgcggtgcataaggccaacgcccagaaggcactcttccatctccctgttggctgacgtggcacctgagttgttcccccttctctaatgcttctccttcagcaattgtgatttgctgcttctgatttctgtagtcctaggaaaccagggaaccatgtttgttagaattatgtgtaaagttaggggacagagacatcaagggggtgtgtaagtagtttagtatgtggctgctttggctgcttttctgctttttgctggctcctctttagagatcagctgactggcgcatggagtcctcaaattttgggggcatgtaataaatgatggatggacctttttttttttttttttttttgagacagagtcttgctctctcactcagactagagtgtgtagtggcacgatctcggctcactgcaacctctgcctcctgggttcaagcgattctcctgcttcagtctcctgagtagccacgattacacgtgcgcaataccacgcctggctaattttttgtatttttagtagagatggggttttgccatgttgcccaggctagtggctaggcgttttatggtgcagaaatggcaccactattttgtgagtattcctaatcaccaacttttaagttaactttttttttttttttttttttggagatggagtctccgtctgttacccaggctggagtgcagtggcatgatcttggctcactgcaacctccgcctccagggctcaagcaattctcctgcctcagcctcctgagtagctgggattacaggtgtgcaccaccatgcccagtgaatgtgtgtatttttagtagagatggggttttaccatgttggccaggctggtcttgaactcctgacctcaggtgatccacctgccttggcctcccaaagtgctgggattacaggtgtgagccaccgcgcttggcaagttaactttcattcacctggtttgggtataagttctctttagttcttcaaactacaacttttagctgactgtatttaagaggagttgggaggacagagcagtagttttccactttgctacgcagacacccagcatttgccaggccttttttttttctttttttgagatgggatctcactctgttgcccaggcaggagtgcagtggtgtgatcttggttcgctacgaactccctgtcctgcgctcaaatgatcctcccaccttagcctcctgagtagctgggactacaggcgccctgctgatttttgtatttttcaccaggttctttaagcatgttgtaaactttgcagaacaaattggttctgggtttcctttgatgggagaggctgcagagtgctgagtctggagccagacagcttgggtttgaatcctggctttggcagttacctgctgtggaaagatggctttgcctctctggatctcagtttctgcatctgtaaaatggagataaacttttcctagcgttgttatgaggattacatgagttactcacagcatgcaatttatatttagtggggatgaggttgaagaaaatacataatttcatgctgctcctcacatatacctaacgtttatgttgcagttcccaagtggttgcaaattcttattctaaaatggtagcttatcaaagttaaaggaatccaaaaatgccatttactgagaagagaagtggtcataacataggaatttttttttttaacatgcttagtgcctttctacttgcacctatgtcccttctcccctagtgtgggggtctgtgggctccccagggtagtgcttaagcactttgcaagaggtgcaggctgctcatttctccgattcccagttccctctgtttcctgggagggacgctttgctgcagcttcacctgcttatccctactctctacagctagatcattgtccaggccttaagctctgtcagtcgggcacgtgtgcacacacagacacacacacgcacagctggatgtgaactcttgactccagtgtgtttctaggccagcctgcttgttgttcctggttgctccgaggaaaggagggtgctgattgctcctctggatccagccggacgcatggaatgctgcaacatactaagcctgtgctctgggggcctaattacgtgggacttggggcaagcacaagtgacttcagcgcttggtttgatccagcgtgtgatttttgccaaagcaaatactttattaatcttaaccccccaaattagacacattgactttttctaaaaatgggaatgattggagagcagaatttttttttaaatcccctccccatcctgaacccctcctccagcaagactgggctctgcattcctctccttgaatggagaaggtgagttccatcactgcctacctcctcctctaacattcctgaaactaggtgctaggaaattgcccctttctgaaggtgtgttttttgtgtgttttccgcaagaggttccactccttcctacgtcaaggccaaagaaaggatttgccgtcctgatggaactttcctaactgggaacttgtcctggatttcttgggattctgatccagaatgtgtatagggaaaactgttgggtgacttcccatggtgaccttgagtgtgtctgagaggctcagccagaatttcttgtgtggcctgtgagtgagctagcaagccagcgaggtcagtgggccttcccgctcaacaccctgtctctctcctcaaagtgtcttgggtaaagggcatactcacagggtggaattaatctggcgttagagagtgagcttgttcttatctagtctaaactggaaaaaaaaaatgcatttaaataagcaacctaacctcaccccagaaaacaactcctagttaaccttggctcctcttcactcggcctctgtctttaagtctgagtgacctggtgggattgatcagctttgaagtcctaaggtgctattttaatactgttcttttacgttgcaggcttcgagactgatttaactagattctggagggagcttactttacagcattcttaagagctcgaacaatcttgaaagagttaaactctaattagctcattcctaaggtatttaatgcccttattaaaactcaactgctcgttcacttttttctttagtgaatcagatttcttgaggagctgagccttcgctcctcagatcacaggctcacatgttgaagctggcagtgctagaggctagttcctatctgtgtgacagcatttttaatttaacaggaccgcctttgatgttcccaaatatttataggcagctttagatcatttcagtgtgtgctttctttttcttctctctctctctctctcttttaactggagcaaaagttcttcctcatgcaacagccttccttttatcctgtttagtttatttttgtttcctttgcagctttggcgaaggctgtctggctgcattcacacacacacatgagattgacccttctttttgcttctttggtaaaggctacctctctgtatcctcctgcctgcttgagattgcttaaggcacttctgttcatcccttgactttcttcaggctgagttttttcctaatctggctcaggaatctgttctttggctgacctgagagctttcagactatcatgcagacctgggcattgtgtgaaagtgtctttttttttttttttctgagacagggtctcactctgtcacccagactggaagtgctgtggaatgatcatagctcactgtcaccttgatctcctcaagtgatccttctgcctcaacctcccgagtagctggtactacaggcacctgataccactcccagctaattttttcacttttttatagagatgaggtcttgctttgttgcccaggttgatctcgaattcctgggctcgagcaatcctcctgcctcggcctcccaaagtgctgagattataggtatgagccacctcacctggccttgaatgtgtctctttatggatgaccaggctgtaatatcctactctgcttgcctgcattgacactgatggggcctcagcaagttatgatttacagtgtatgttttgcagatactgttttagctggggcaggaaattcagatagacagaattctgtcctgatcatttcaggcttgctctgtttggctctgttagacttcttggctgaaaataacagagaatcaaagattttggtctcagggatgggaaaaacagggctgcaacatagatttgttaagccattaagaaaaagaaaaaggaaactttgtaccaatcaaaacaaatgatagaacagaggatagtgcttcctccagcttggcctctgggtaaacattctgcttgtgaaacaatccaaattactgaattctcagctgctgttacttacctgggcctggcagacagaagaccagaagatatcatggcttcttccatcattgctggctgtgcctcctattaggtggaagccttttagtgctgaaggtctcataggtggttgatgaaatgtgtgaatgaatgaatacactattcttgggaccttatactgtttttctcactagatccttaagaggattctgagcgataagatatttcatatctgtttttttagatgaggacactaaagtgcagagaggtttatacagctggtgagtgaatggagaagctggcctggagctcaggactgtgtcttatagcctcaccatgaggtaattggaggcaggtaaatccaatggcagtctgctaacctcttagagctaaaaaagcctgttgaggctaagcatggtggctcacgcctataatcccagcactttaggaggctgaggcaagtgaattgcttgagcctaggagtttgagaccagcctgggcaacgtggtgaaacctcatctttacaaaaagaatttaaaaattaactgagtgtagtggtgcacgtctgtagtcccaactactcaggagattgaggcaggtggattgcttgagcctgggaggcagaggctgcagtgagctgagatggcaccattgcactccagcctaggtgacagtgatctgtctccaaaacaaaacagaaacctctcaaggctaaaatctactgtatgttgcattgtgagagttcagagctgaccagattcttgccatgtaaggggcatagtggtggagagtacatccctgagaccagataggcctgtgttttgcatctcagccctgctactgacagctctgtgaccttggccaggtcatccaacctctctgaacctctgcttcttcatctataacatgggacagatagcttgtacgaccaaaagactatgaaaattagatgatatatgtaaggtgtacattaagtgcttaacacatgttcggttggtgtctgttgctacaaaattgtgactctcaaagggttcatagtcctgcaagaaagcatcaggtaaaccacctattagaagacgacttggcagctacaatagagagacgtgctggtgctgagtaggaacccagggcagaaaccactggcttggatttttattttctttcattcagcagatatgtattgagtgcttaccctgcgctggcagagccactggatcacactgattgctgccagctccccctcacctcccaattttctctttcccttcttgggagaatttgagctaaaatgttaattgccacctgaagaaagattttcacggagtcattttcttttctttctttctttctttttttttttttttgagatggactctcgctctgtcgcccaggctggagtgcaggggcaccatctcagctcactgcaacctccgcctcccgggttcaagcaattctcctgcctcagcctcccgagtagctgggactacaggcacacgccgccacgcccgtccagttttttttttttttttgtattttagtaaagacagggtttcaccatgttgcccaggctggtctcgaactcctgagctcaggcaatctgcccaccttggcctcccaaagtgctaggattacaggcatgagccaccgtgcctggccacatggagtcattttcacataaaatgccaaggtgccaaatggcacagccacactgcatttgaccatgtatcttacatggccttgtgctgtccttcaactctcattttaatcttatctaattttctccaatttctctggtctcttctacatgaaaactttatggtccttgagaatgtacaagcgactcaccaagggagcaggtggtggccgcatggttccccacagtgcccagatggtgtccgtgcctttcatggtctggttccatggggatttgttgataagattttgctttcatttggttttccaacccagcagcatatttagatttgattactggtactagcttttttctctgcagagtttcattgtctgagtcactggctgtcttgaaacataagtcccattctccacacccctgtacccctttgcaatcagtggggatggttatgtggtagaactttttccctgcccacagcgcatggtgcagagtggtgtcagcacactttcacttgctgagttgattggtaacatattgaatctagaacaaaagatacaattgaaaagcatttgtggttgtctttgtatagttacaagcctctaaaatagatttgaggtcatttctatgtctttccttttgaattagcaagcaagctttcagagggaagtgggcgttttctaaatgcactattgatttgaagctaacatgatgctctacttttggatcatgaaaataatgttaattttttatttggctgtttggagggaccactggagtaggtcatttatattcaactcttattcatgctttctttaaatagcatgtttaatttcacattaaaactagcttctgttcagctaaaacaaaaactgaaaagatggtttggaagaaagcaaaatgacagagaaaatgcagcatgcaatggaaattggctgcaagtcatctccataaggtgattgagaatgaagtgaagctcagctttctttccaaagaaccctcaacaaccctctatgttaacttaccttctcctgggagtcttggtggcctccttttgtccttggtgtatgttgcatgccaatcatgctgtagagaaggcagtaatatctagaaacacatcttgaactagcgttgggccgtgtgcaagtctcttttggtggggatatgcgagagtcactaactagcaacctttagggaaaaagaagtccaagagggttgaattagtaaccactggggcctgtacgtggtgatgtttgcttttttaaatgatccttgtggagcatcatttgccctgtgtcctatggggcatgtcaccccattccctggatgtcaaaactaagaacagaagcaaaatccattctgcattggctctccttctttagacttagccggattgctggatgcgcggtcagttggatgcaaatttgcttttgctaaagaaaaagaaggcctgcattaataatacaatgataagacctgtgctttcagtttgtgttttttaaagcggtgattagatttgtctgggtggagagcaaagatgaagctattggtctagtagagaccattggtccccagatgagggcctggtgtctccgttgggtgttttgtttgtttgtttgtttgtttttgagatggggtcttgctctgttgccaggctggcgtgtagtggcacgatctcgactcactgcaacctctgcctcctgagttaagcaattcttctgcctcagcctcctgagtagctgggattacacgtgcacgctgccacacccagctaattttttttgtgtgtgtgtattttagtagagacagggtttcagcatgttgcccaggctggtctcgaactcctgagtctgcctgcctcagcctcccaaagtgctaggattacaggcgtgagccaccgcgcccagcctctgttgggttttttaggcacacttgtctgaagaaagtcttttgattttgagccactttttagagctttgaagctcttcctgattttaactattgctacctatggaagagttgctctttgggaatggacagcaacttggggctaacagcttttaagcatggacctctcctgggggcgtgttgggcctgtttactaaccttactgtggactccgccttcagatcaggatgattttcatggtatttttttttttctcagaaaataatcaaaccaaaactttcccttgctgatacagagtgactatgcaaatcaggtctgcatgcttatcttcctagaaatgtagttcagtgaaaagaaaacagcgccttcctttagcccacatactttcctcattcataaaatgaatcagatgaaacttgatttcacccaggctggagtgcgggggcgtgatctcagctcactgaagcctccaccacccaggctcaagggatcctcctgcctcagcctcctgagtagctgggactataggcgcatgccaccatgcctggctaattttttttttttttttttttttggtggtagggaaagggttctaccatgttgctcaggctagttgcaaactcctgggctcaagggatccattcacctcggccttccaaagtgctggaattacaggtgtgagccaccatggctggtcacgcccagctaatttaattttttttttctagagacaggggtcttactatgtttcccaggctggtcttgaacttctggcctcaaatgatcttcctgccactgcacctggcctgatttgtatttgggagcctcactttctccattaactttttttttttttggagacagagttttgctcttgttgcccaggctgagatgcagtggtgcaatctcagctcactgcaacctctgcctcctgggttcaagcgattctcctgcctcagcctcctgagtagttgtgattacaggtgcccaccaccacaaccggctaattttttgtgtgtgtttttagtagagacggggtttcaccatgttgaccagattggtctcgaactcctgacctcaagtgatctgcccacctgggcctctcaaagtgctgggattacaggcatgagccaccatgcccagcctctccatcagactttggatctggaagatagtaagaaaaaaagcaaagtaacttagttctgtcctttcctagaggacgtaagcagtcttggcctcttcatgatggtccactttgttaccgaattattgggtacaaaagtgaggtctgcaacaggctttggatgtttcaaggtgtgtctggctgtggtttgctttctgagtgccagctttaatgtcctcttattttctggcaagggttgatggatgtggcactgaatattttctgaatagtgttcacagaatcaccgagtgaatgctggcctcctcctgcatgtctgttgagggagggcttatggaccagtgggaaagtcagatgtgtccctgagatggtgacagtataacatgcataggctgagtgccaaatgcttggggcccagagaaagtgcctagaaatcagagaaaggtcttgggggtggacctccagctggactcttaaggaagattggtgcttggatttgctcctgctggctcttgctatggggaaggcatttcttgctgagacccaggctaggctggcaactagtggagctttttctagcttgtgtagacctggaggctgcctggcatagaatgtgcccatggcagggcggggagaaagaagaggccaagtgaggtgcggctgggagacaacagatctgctatgctctctggtctgtcatttaagtgggatctattggattcagcctttctgagcctcagtctccacatctgcaaactgggtgtggggctagatgagattcctggggggaattgggggatctgcagctgtgcctctgaaggatgtctggggacagaagtgtaagtggggaagaagcacactaactggggaattggggagggaaagaactttggagggcaagttaggggagggataagaggggctttgaatgccagaaaagggtatgtgacttttatcatggagaccagtgggtcccatagtcagaatataggtgatgtctatgtgcatgaccgtgtttttggtgacacaactcccgcctgccctgtgtcctccagcagcatggtatgtaattgcagccctcactgcacagcagtcggcaggcttattcaggggcagttttccagcagtcactcctctcttgagaacagtctggaatgtaagggagtaagtgatgttctagtgacaaccttgaattcactttattaaagataaataaatcacatgccaactctggcctttagctgttattagtaacaaatagctttctacccgtacacttgaccattcatgacaccttggaagaaaattgctgccatggcatttgaccttggttagcactttgttttttctgagagtttttttttatatatcatgagtatgtagaaacttctggggagcaattcctcagttgcctttcgagtcctgcccctaacccctcagtttgggctccatctgttgactgccctgggtttcagaagggagatagtgagtgtgctctcttgaacatggtcctttaggattaggcaatagagtggtaggctggtttagacatttctggttattgacaggccttactgcggcttcccccaaatgaatgaggaatatatttttctaaatccagccagtgagccaaatgagccacactgggataaactttgtttgtttacaaattatgtaagagaagggcccggccattaaattcttctgagccagaattcctagccctcttcaaagttgtaatcaaactaaacaaacactttccacaggaactaactccctcccgagaaacaggagcagatgctcctgggaggccttcagcaactttggaatgtttaaagtagaaatatgtaaccaaggtgaagttgttccagaaacattgcctgctctggccagaaccaaagcacgtgtcagcttttttatttagggcaagaggtgcagaatggactgggccagtccaggcagaattttctttagaatgtttaatttttggttttcatcttaacccggcttctcatagtatcagctccttgtgacctttattcccttctgcttaagtaactctttttttaagcttgatcttatctcttatcttttagctatgctggattacatccggggatcaaggagcccgcctcttaaagcactcaattattgtccctaggaaagatgtcagctgtagcacaaacactccaggggagggaggctgaggctcgccttaacttcattattgtctggataagatagggagaattgccactctccagttcttttggagatccacaaagaccgtccatctaggctcagggacacggttttcttttctttctttttttttttttttttttgagacggagttttgctcttgttgcccaggctggagtgcaatggttcaatctcagctcactgcaacctccgcctcccgggttcaagtgattctcctgcctcagcctcccaagtagctggaattacaggcgcccaccaccacacccagctaattttttgtatttttagtagagatggggtgtcaccatgttggccaggctggtcttgaactcctgacctcaggtgatccacccatctcggcctcccaaagtgctgagattacaggcgtaagccaccgcacccggcagggacacagttttcgaatccttgccgatttgagtctttactgagcggcttgatttatcttggcttgggaagttgtggatttttagaacattgggtacacttgtattaaaatagatgtatactttcttaagccaattgcacatttttctggagtatgcccaagatgagcttttctcaaggcatcgcctgaagaacagcagtcctgcacaatgttctgtggtgaaagggttctatgaggatctatgctatgcattaatggtggggctcagtatttgagaaatactgttgatcctagttttctcttagagatatattctgcacagtagtgaattaatggctctgagaaattctgttgaagagcggtctttcactttatttaatctggtacttcccaaatgtacttgatcacagaactttttctcaaaggactcaaggtgctaggggatatggagtggcgggtagccagtattaggttagtttagggtctgcactggttcagttggtgtcctgttagattatgaggatggaaggccaacaccaagttaactaccagctttccacagggccctgggatagagtcatcaccacctagaatgaatggcctgaacacctttgaactgtggtaggactatttcttccatttcagcttagatttgtggtcttctctataattgggtgatggggtatagggagttgtagtataaaagaaccaagaaacagtgcttctctttgaagaatttaatttctactggaatgggaagattcatgaaggagttaaacagtaccaccgtccaagtaggtatgaaataatgtcaagtagcctgtcttgtaggcattttgtagcctgtcttgtaggcaggtgggggccacaggaagcaggggcagcctttattgtgacttgacttaccaaactttgggtactgtgatggcgggcagataagatagaggagtccccccgacccctgcagccctaaatgcctcttcgtttgccccgcctctgtgtgtaatgtactatgtgtgaaagtctcttagactccccgcaaggtagacattttagagttggatgaaatgcatgataagaactccttctggtactttccagatgtatttgatcccagaactcctttttctcaaaggacccaaagtactggggaacatttggttccttctggaaggagaactccctctggctgatctgcaggcccccactgctgggttggcatcctggatttcgaggtggccaccttctgtgactcttaggccttgagcttggctatctggttttggagacctggtgccttggaagtgctgggctgagttgaatggaagtgcattttccgggttagtctaccttggttaatgcagggaagagtaaataggctctgctgactctagctgcccataggaaggatgtgtgtgacataagcggggctgagatatcccccattgagatgctaagaggaaactgagatgaggagtttaaattcttctccaaatatgtgtcatatttcatagactgttgacatagagcttttttttttttttttttttaaactttaaaagttggaggccgggcacggtggctcacgcctataattccagcactttgggaggccgaggtgggaggatcacctgaagtcaggagtttgagaccagcctgaccaacatggtgaaaccccgtctctactaaaaatacaaaattagccaggcatggtggtgcatgcctatattgtcagctactcgggaggctgaggcaggagaattgcttaaacctgggaggcggaggttgcagtgagccgagatggcgccattgcactccggcctgggcagcaagaatgaaactccgtctcaaaaaaaaaaaaaaaaaaattaggttaacctacctgatggatattgttggcagctgagctctgtctagcctgggacattcagccttttgcctctagctttcgatgaggccccaggctctgctgtgtattaatggtagggcttagccttagttcaggacccatcccctgtcatacccccaaaccccagaggggaggcgttctctttttgcagatgcagattatcagaaatcgttcttccttacactgaaccaaatttcttctgctccttggttctggttctgtcttctagagtatattaagtatcctttggttgctataacaaagtaccactggctaggtggcttaaatgacagacatatttactcatgattctgaaggctagaagtccagaatcaaggtgatcagggttgatttattctgaggcctgtctccttggcttataaagtgatggttttcctatgttttcacgtggccttccatctgtaactgtctgtgtccaaattttctcttcttataaggacaccactcatattgtattagggcccacctatatgacctgctttaacttggtcacctctttatagaccctctctctaggtagtcacattttgaggtactgggggttaggaccttaacatatcaatttttgagagacagaactctgcccataacacagagccattaagacatgatgaccctccagatttctgaaggtgattttcttgtcacttgtcttttccttgctgagaacccccagttctttccgttctttatatgagatggttttgaagtccctcaccatcttggaatcttctggacttgccttagttttggaaggacaaagtggaatactttggactacccgtgatattatagatagaattcattctaatgtctgcccaagcaaacaattttgatgatttccgaaaaagattaaaaggctaaaaatcagactgtacagtttcagtaacagctttaagatatttgtctttaattttgcctgagtaggtctgaccactgacacacacacgggcaccgcccccatatcccaccccatgcatccagtgctaactttatgtcttcttttgacttaagcatttacgttagagttagtaagtgctcaaggtctaagtttgttcaccacccttcctcccttccttcatacttttttagttttaggaaacctagttgggagggttatttcaaaagaataaatgaatgtagagatttttattttttaaatttaaattacatttaatttttttgagatggggtcttgctctgttgcccaggccagagtacaatggtgccatcacagctcactgcagcctccccctcctgggctcaagcaattcttccaccttagcctcccgagtagctgggactacaggcaggtgccactgtgcccggctaattttgtttatttttttgtagaggcgaggtctcactaggttgcccaggttggtcttgaactcttagactcaagggatcagactcagcctcccaaagtgctgggattataggcatgagccaccatgcctggctgagatttttattttttaaatgtaattgctgtctggagagggtagaaataactcagttactggagtataactcattttaggttcataatgtcatgccaacctgtagtgtagttagatttaaaattattagttattctcttcacttttggaaattgtttactttttattgcccttgtgcaccaaaaattgtgtcaaaaaagctcatatgttttgttctttgcattttcagcacttagcagagtgaaggttaaaaaaaaattgttgagtgactaaaggcatcctcttaatcatcttgtgcttatttaatcaggagcatcctgttgtgtctttggtagaattggcagcttggggtttagggattattctggccgctgtcccttttgcttttgaattgtggagctccccacaaagagaccctcagtgctgttcactcttctgctaaattgtggtttgtaagtcctgactgatagttttgacaggctttttctccttaccgtagtctctttagatggagtgtgacgctcttggagttcctttctttgaagatgctttgactataccgcccaggatttccaaattgtagcctttagatgcctggaaccctggccccacacagctgttaggccccctctattctggaggcccgacaacattaaaaataccaactatttatagcatacttttcagtgtcagtaaattataggatgcccttgccagtggatggggtgaacgctcatctgcctgccactgtgtgattgcctagaagcgtcggccaggtggcaggagctcagccccacctgaatgctcccaggtcctcacctggcactcccacaggaaactaaggactgccaggatgtcttggggttccagtagagtccatgtcctttgcgatggagtggttggggataaaacacacacacacacacacacacacacacacacacacgacactaggtatgtgtgctcttgagagaagcccattctgatctaactgccaactcctcaggaggctgtgttgtcagccatctgtgcacagaagtttgctgcatcactggtgagctggggagtgtcctgtgtggtgtccacttaatcttactaggaaggatcccctcatttcaacaaggtaactgaagaatgttaaatctaaatttgggtaagatatactctctgtaggctgaagaatttgaagagtatataaaagctcttatagctgggtgcctatagtcccagctacttgtaaggctgatgcgggaggatcctttgagcccaggagtttgaatccagcctgggcaatagtgagactccctctctttaaaaagaaaaaaagcttttaaaaaggccaaaaggacatagggtctttatcttccctcagctgccccttggaaaggatctcctggcttgccattcagagtacacagtgaggggaggccccctccacagggtaccatttagaacaggctcagtcgttagaacactgcagagggcgtgctgtcccctggccaccaagccaagttgggcttttggggacaggttttgtggtggtagcttttgggttcttcatttctttgcctggactgaacagtgagcagtgctcaagaggcctgttctgttagctggagtttccattgaagtgctaactgctggatcctttgaacctctagcctgggagggtatttataactagctgtttgcgtgcttagaggaactgaagtcctgcctttctgtagtggtttaagagctgtgcccttggtgtgggctgaaaggcaggcctggcgaagtgtggggactcaaatgcccaactccccacgaccttgtttgccttccccctgccctgccagcccagcggcccttttagggttaacttctctgctttggaagcagctggccagtttacactcctccctgggctgtacaaaaatacttcctttgaagtgttaggagaagcggtgaagggtaaaacctggtgaagaataaaacctggagtggggcttgaatgcatttctcttccagggagtttgctgggtgactgagccccacagccttcctcgtaacctatagagctgagtggttctcctcacatagttacagcttggagcctagttgcagctggcatgtgcatgtgtgggtgcgtgcgtgtgtgtgtatgcacacgtgtgtgtatgtgtatctgcatgtgtgcgtgtgtgtgtgtgtgtgtgtgtgtgtgtgtgtgtgtgtgtgtgtaaagtctcctcaaaaggagtatttcttttcaagagagatagttagaatacagccaccaagcttgcctggtggctggaatccctttgaaggcacttttccctagggcgggtctgagtcagggtggtatcctggggtatgtgcgaagctacaatgtttccacttcgtcctaaagtggccagccctgttcttgctccctactggggtaggaaagctgccactgatcccatctctgattcaggtcaaagcacagcagcctaaaagaacgctgggcatgaagtcagtggtgctgacttctcttaaccttgggtttcccatcaataaagttgggctggtggaaataccggattgggggcaccttgagaaagtgcaagacacttctctactgtaaagcctgcagttgagcagaaatggcatttaggataaagaggccaaagagaagaatgccagagcagaaatgagacggaacaaagcttgaatgtcttcttaatccttgagtatttgcagccaaggaggggttggggcaagatgggaggagaggcagctgttattttctagagaagaatgccaacctgtttctccccacagaggggaccacacaagttatttctgaactggagtttgcagtcccttctttcctggaaaatgccttcatatggatttcttacatcttattacactacttcctatctcccttagacaaggagtgtcccttagacagatctaaaataataccatagagctaacatttattgttggcttttgccaggtattgggttaagcacccaacattaatgatctcatttattcctcataacatccctatgctggttgctgctgttgtcctcattgaatagatgaggaaagggaggctggaaaaagtgagatgacttatccaaggtcctcttacctactgatgcaggtatggaaatacagacccggttagacttttagcctctttacttttttttttttttttgagacggagtcttactctgtcacccaggctggagtgcagtggtgcgatcttggctcactgcacctcagcctcccgagtagctgggattacaggcgcgtgccaccatgcctggctaatttttgtatttttagtagaggtggggtttcaccatgttggccaagctggtctcgaactcctaacctcaggtgattcgcttgcctcagcctcccaaagtgctgggcttacaggcatgagccaccacacctggccccctttactcttaagagatgtaagttacaataagcgatgagggggtgaaatttaattctgtgccccaaacctgatcagaagctgtttttaaggaaagaggtggaacattgaactctgttcattctggctgttttgactcatgttatattcatcagtggacttttattttattttttgagatggagttttgctcttgttgcccaggctggagtgcaatggtgcaattttggctcactgcaacctctgcacctaccctggattcaagcaattctcgtgcctcagcctcccgagtagctgggattacaggcatccgccactatgcccagctattttttttttggtagaaacggggtttcaccatgttggccaggctgatctcgaactcctgaccttgggggatccacccacctccccctcccaaagtgttgggtttacaggtgtgagccaccgtgcctggcctattttattttattttttgttttgagacagagtctcgctctgttgcccaggctgtagtgcagtggggcaatcttggctcactgcaacctctgcctcccgggttcaaacgattctcgtgcctcagtctcctgagtggctgggattacacgtgcccaccaccacgcccagctaatttttgtatttttagtagaaatggggtttcaccatgttggccaggcttgtctcgaactcctgacctcaagtgatccacccacctcggcctcccagagtactgggattacaggcgtgagccacagcacctggccagcagactcttattgatcagttatatttcaatacacatgagtgcgttttgccttgcggttactgaaaagaaacttttcttatttctcattctctgtgttgactttacaatagctatgcttttttccctctcattagaaagggttgggaagatggctgctctgtaactgcagctttgttacggttgaaggtcttggtgtcagggattgacgggtagcctgtaccccttggaatccttagctgtaggctttggtctttccccagcctagaaccagacttggcacttacttcaaggggcttgagatcctgtgcttgaccctccttagctcatgggggaaaccaaggcctgggaaagtttgagtgatttgcccccagtcacacacggggctagacccagggccaggctggcaggttcccagcccactggccacatgcttctccttttcacctgaatttcaaacaggagggaagatgaaagggatagaaatgaccagtcagaggagtaggagggctgtcatttgcaaacagtttcttttgatctttgccccattgtttaaaaaacccccaccaaaccacaactggtagcatcagcacatggttccctccggttcattgaggggcagtcatttctcttttaagtgggaagccccccccacccctagtagtctgtttcacttagggctccatacctcctctccccttctgctactcggctgccagatgtgctccccttcacaaacctttcagagctttttactgcttataggatggagtctaaccccgccttcccctaatattctaaagcccttgacattttgtgcccagtctgtctttgcattttggcatccaaccacagagccccttgcctctagtcaaagggctcctccgaatgagctttggcctttatttgcatctttgcccacattctgcccatctttcaatgctgctgcctccaggaagctctgttggactaatgcagcacccagttgcctctgctgcctccgaacctgaaacaatctggtctggcaactcatttgacacttaatattgttttgtgttgtttaacttgtagatgtgtctgtctccctaactagattgtaagttcactgaggtcaacagcatgccttctgaactgcttcgtattcccctctgaactgtttcatattcccccacagcattccacagggcctaggttgtatgctgtgcaaagatctgggactgaaatgctattatctttctaactgttaataggaatggaagaaattagtttccccaaaaaggaataaaatgattaactagagagatttttaataggatctgtgctacgttaggattaatatataggttgagtatcccttatcctaaatgcttgggaccagaagtgtttcggattttggaatatttgcatatacataatgagatgtctggggggtgagactcaagtctaaacatgaaattcatttgtttcatatacaccttattcacatagcctgaaggtaattttatacagtatttttaataattttgtgcatgaaacaaagttcctcttaagtacttatgtgtggaatttccacttgtggtgtcatgttggtgctcagaaagcttcagatttggaagccttttggattttgcgtttttcagttaaggatgtttaacctttactttaaatcgggttacttgaatgaatcagggaattttagtttgttgtaattatttttttgtttgtgtaattttgctggcaaacagtctatagtgaaaattttgacctagaccccttcaagatgaaagtaaataaatgcatgttatttaaaatttgctgttgttgctatttagcaccctagatgcctgtttacttttttactttgttgttcttataactttttctctaagtaatttcttggatccgtattcgcactgttacaattgtgttcttgaacatacttctaatcttttttagccattatgataatatattttgttttcttgaccctttctgtagtttgttaggttgatggcttccactggaattttaggtttgacctcccaaaggtggatccacctgtatgggaaagatttgttttcccttctccatcccctcccagtccctctgcgttctggccttgggtgtatgaaattctggccttgaacacacctagcagtcctggcccatgtccgtttcccagttaactcttttgtgcccgatctatatgtggcatgttccgccacagctgtgggtggaatcatgcttgtgcccccatataaccttttccttcttagcatttttttcttttcttactcctgagttaaacgtgtagcagaagaggtgtaaagacacagggccagcatgaatagtgctccctttttaaaatgtggaaaccggcttggagaagttaagtgacttatccaaggctgtacatccagtaaggagaaaaactggccttgtgacatagccccagggatgtgctgtgccccgtgatggccccatatgttggtgttgggagttcagtggctcatcaagtgcctgtagctcttaaaggaaaggagttgataaaatgaagcaacctggggcgcttactccaggggccatttctaatctgatttctgtaagtagtggatttttgagagtgggttcttgtatttcctcctggtctgctgtgttcatgggtatttttctggagagatggactctacatcccaaaactggtgaagatcccctgatagaggtgccgctaatgcccctccccatgcagggattgtactggagaagctgtgtctgtggcctgcacccctctggaagctccagtgagtgtcctggggacacattaggaaagtcagatgtgatctaccctcacacccgccagtctcaaacggctttttttccttcttaaaagtaagcaaggaataaactttaaaaatagcaaagggtcagaagttcctttttttttcaagcttttattataggaaatgttacatgtagactccaatagatagaacatgttatgtacacaccgtccctccatatactcaccatcacccaaaatagttgtcaacacctggccccgcttgtttcacttacacccccatgccaccctcatgttattttgaagcaaagccagccatatcatttccctgcccgtaaatatttctaaaatatctataaaagcttctttttaaaaaacatgatctcaaggctgttcccacaaatgttaagctagtgatgtcccctcccaaggggcaaccccacactccctgagagatggtgtatgtgtttcactgctcatgcactggcagccacgtctagaggctgggtctggggtggagcccaagtggggtgggggaccgagcgggcgaggccatggctttgcgctggccgggcaatcatgatgatctcggatcccgcgtgggcgctgtgatggtatcggctttgccccgggcgggaaccacaagatcaaaggcgccgcgcaccggggtgcttcaaagccagtggagcagcccggattgatgcccagaatgagagctctctgctgatgtaatcgtagcctgtgagacaggttctttttttaaatttaaacaaagacaccccttgtttgtttagtgaggtgaagcatgtgttgcagagggcacgcagcatctggagggctccactctggcctggtgggtccatggtagggcaggaatgctgcaagtgactagaattttcaggcgggcttgtagatcttccataaaagacaacctgtttctgttaagagtaatttttttctcccttttttagtatagtcaggcttgttctcaagtgactttcctgaaatactgaaagtgctttcctctggtggggttgtcaggctttggaacacacctggtgagccagctaggaattcagatcaaaaagtaggtaagcagccagggcatggtggctcacgcctgtcatctcagtgctttgggaggttgagaggattgcttgagctcaggagttcaaaccagctggggcaacatagtgagaccctgtctcttaaaaaaatttagctggctgtggtgatgtgtgcctgtagtcctagctacttgggaggctaaggtgggaggatcgcttgagcccataagttcgagactacagtgaactatgattgcatcacagtactccagcctgggcaacagagcaaggccttgtctctaaaaaataataataataataatttttaaaaagtaggcaagagggctgactttggtcagtcattccttgggtctagaaaggaagctcatctgtcccttccctagagtatgtgagaggcttgcccaaggctggtagtcagatcccatcctgttggaaggagagaggggtctccaagaatatggctgagtgccaggatcaccaccacccctagcctgaatattctcccagtctctgtaaaaatcatagacatgtggctgatttttctggggtattcccagttaagatggtatccctgcctttagtagttgatcagtacacaaatcagtgaaaccctgtaccatacatacctccatgagtgaaatcgtggtcatattctgttttcttgcttagcaaatcttgctgacagatagatgaagaagcctgccaaacggagtcagcttgttggatgctgaggtccttcccaagatcttccctacatcagaattcagggtcagtggggtctgaggcactactcaacttaagtcatagtgactaaagtccacttcagcatcttacagatgtcccaaccaaacccagcatgtgtaaaaccagatttctcttctctccacaaacctgtttctgttaggttcttttgttactccagctaaaaagctggtgtcattctaagctgtttatcctcaatgaggtgtccccttctctaaccccatgatgcctctacccatgcacattgaattgtctgtaagttactggaaggcaagactggaagggtttttccttcccttttaaactacaaaccaggtttcccccatcttctgtaaaagcaccccccaatattgtgaatttcaagcatgcaggaaaagtgagagttttgcagtcgacacccatatacccactatctatattccaccgttaacatttcactgtatttgctttcttacattttttatctatctgtgcatgtgatggggttttttgagacaaggtttgcccaggctggagttcagtggagcaatcatgaatcactacagcctcaacttcctgaactcaggtgattctcctacctcgtgatgggtttttgatatttgaaaatcaagcacatgggggctgagatgttataatggatgtgacagagtatgtaaggttccctttttaatttggtttctatcacttttagatccaggtctccccttctctccctatctactgcctccccgctaaccaacccctaccccatcccctggctgggaatagccctagagatcttgcgtctttgttcagacactcaagggagaacccaggaagttgcacctggaggaccacctggggcatggagtttgctatggagaccctgttgtgtttgaatgacttgccctctcacatttcctaaagcctactgcccttccttcatcttgtccctctctttgccttctagtggtctggccttgtggctacagtgagcatgtgcacattctgttcagagactgcagttttttgtgcaatggggtggaggtgctgctgcagagcatggagcaagccagctgggtgggacttctggtgggttttaaattgatttgaagaaaaatctctaaacagtattttgtttctttgattgattgatttttttaaagagatgggggggtctctctatgttacctaggcagacctcgaactcctggggtcaagtgatcctgccacctcatcagtctccccagtagctgggattatacacacatcaccctgcctggctttttttttttttttaattttattttttaaagtcaataaaataggccaggcatggtggcgcacacctgtaatcccagcactttcggaagctgaggtgggcggatcgcctgaggtcaggagttcgagaccagcctggccagtgaaaccccatctctactaaaaatacagaaattagctgggcatgggcatgcctgtaatcccagctactcgggaggctgaggcaggagaatcgcttgaacctgggaggcggaggttacagtgagccaagattgcaccactgcactccagcttgggcaatgagcgaaactccatctcaaaaaaaaaaaaaaaagaaaagaaaaggtgaataaaacaagtggctgggcgcggtagctcacacctgtaattccaatactttgggaggctgaggcgggaggatcacttgaggtcaggagtttgagaccagcctggtcaacatggtgaaaccctgtctctactaaaaatacaaaaattagctgggtgtgggcacatgcctgtagtcccagctactcaagaggctgaggtgggagaatcacttgaacctgggaggcagaggttgcagtgagctgagatcatttcactgcaacagagtgagacttcatctcaaaaaaaaaaaaaagtgaataaaacaagttacttttcttgagattatcaatgtaaacttgagttttggctgagtaggggcattccattggacttggcaaagtcagcttatctgaaatgttaacgctttcatagaaaggctttagcttttcttgtaaacctgctcaaagcaccgggcgtggtggctcacgcctgtaatcccagcactttgggaggccaaggcaggcgaatcacaaggtcaggagattgagaccatcctggctaacacagtgaaaccctgtctctaccaaaacaaacaaacaaacaaaaaaaacctgctcaaaggatccgggaagcccagaaaaatttgatttatatattaaatgagcatgttttgcaaagttaagatgagctacaacttgttgcacttagaatggctttatatgaactattttcttttgctttgctctgtatcccctccaaaacaaattaatatgtgattctgtgtgtgtttgtatgtgtgtgtaaggtcttttagagtagaagcagcattcatcatcttcgctgttgtgaacaggagctggacaggtctacaagctaacctgattcttagaacagactagattcacagaatagataagctctttatcacatggcagcatattttaattccagcctgtggcttccctccttacgggagctcagatagatttctcttttactgtgtgtgtatgtgtgtctatatgtgtgcatgcatgagtgtgcatctttagaagcatgatctgactttgcattgggctcctatggcttccaggatgccaagagctgtgactttagctacctgggtagtggatctgctgactgtgccttttgtgccagtgttgtgcctgttgtattttgctgtagctatagaaggcagctgcacaggctttaaataatgaagtcaagaccaccatctccagtttgattttgtttagagaccatttttggtacagtttagagccagtggataattgcaagttgattagtgtctcccaaccttctcttttggtctgtatttaatttttgcccaatcttttttaaattttatttttaaagtttttaagcccatagaaaagttgaatgaatagttagttgtgtgtggcaaaatgttaacagttgcttgatttgtgaattctctcttacatacacttagttttgattttttttacccgcgtttttactcactttttaaaaccacctttttaggccagactatttgaaagttgccaacataatggcatttcacaccttagtactccaacatatatacatctgctgagaccaaggatgtactcctaactgctgtgccattgtcacaccgaagaacttgacatatttaaatttctctgattgttccagaaatgtctttttttttttttttttttttttgacggagtcttgctctgtcactcaggctggagtgcagtggcacaatcttggctcactgcagcctccacctcccgggtttaagcaattctcctgcctcagcctcccgagtagctgggattacaggcatacgccaccaaacccggctaatttttttttttatttttagtagagacggggtttcaccgtgttagccagggtggtctcgatctcctgacctcatgatccgcccgcctcggcctcccaaagtgctgggattacaggcgtgagccaccgcgcccggcccagaaatgtcttttatagatggctttaaaaaatccaggacccatgcaaggttcccataaggtatttaaacttttaaaatatttatactgaatagatgcacaggtcctataatgctaacaagaggcaaaagacaaggaaagatttctctcacaattctactaccacagtttcaaaccaatttctttttcatctctctgttctttaaaaatgaagctttggacagattttctttagttcactttcctaaccatccatgagacaaaaaaagaacactgatcaagactgtggtgctgtttgactgcataagcacaaattgtggtctttgaaagttcttgctgagagatttggagttttattaagaataccaggaagccagcggcctttgagtaatgtttgaaacaagagggaagaaatcaactattgcttttgtttgttcaaaagctgactttattgatgatataacagtgtctgtaggtcttgggattcctttttccttattgtagacgtggtttctccaccttggcactgatgccatttggaactggataatttttttgttgtggctcctgtcctgtgcgttgtaggatatcgagccacatcccaggactctacccacaggacgccagtagcaaaacctccttcccagttatgacaactagaaatgtctccagacactgccagatgtcccctggttaggggcagggaggggcaaagttgacctcagttgagaactactgttctagaaattcttcaggactaacttaaattgagattgactgtgttactgataaatttctgcggagggacattttcttttataataagccccatcccaatctgaaaatccagaagtgtctagatgtccactggccaagggattgaaatcagttggcagatgacaactgagtgtgtgccttttcacgattttcacactttagcagaagccttgttatctgatactgttgggacctgtaggtggttgggtaattgaaaaaggtcagttaaattgaagcagggaatgatttaaaaagaatcatcttaagttttaattaaagcttataaaagggattcaagctcaggcctttgtgaataggaccacagatatgcactccttacattaacctcagccttgatgtatcgtttaaaacatttctctcagtttgagaaaaaatagaaataaaaaacatttaaaaagaaaaaatgaaaatgtacatttctgatgggttttttatttgtttgttttttcaaagcagaacaaatacgtataaacacttgtaaagctatcaggaactatctagaattttgcttttttttgtcttccaaagttgcacttagctctcaggtgcttttttttggtttttgttttttttgtagttatttgccttcatttagtctttctatccaaagtatattcaacttattttcatagaataaaatagtatattttgcattgtttaatattaaaatcagttacataattataggaggtgagtctgcataaacagatctagaaacacatatagctcagctggtgggagcagtggtgtgtggaggtactagagagtagtttcccagccaggagtctgcagtgcatgcaggctgaagttataggtctgctaatagcccctgccatattctgaaattcatggaaagggccccagaggatggttccgatttgagagttggaagattgggttcaagccccggttctgttgctttctccatggttttgggacaagcccatcagtaggcacaagcctcaggttgcttatctgtcaaatgggaatgatagtaatgcttgtcttgactacggagcaggttatcttgcaggttacacacaggccacataacaggaaatgcctttataaatgttccatggcgcactggtatgttattaatgagctggttatgctgagcctgagatgtgcacttctgagaatgtgttggctatcctttgctctttgagcacagagcacttgagcctcacagtaagagatttaggtcagaagaggaatggagggggccttgctcaatgcaaatttatacccactcttgcagaaacagctttgggctcctgccatgctgaaggtggaggcacatcacatggctgggtctttgtcataggttttgcttgagtggagattactggcttctcagtgataaacccagtgagcaggcagggggtgagaataccaagggtttggccagagtataacaggcagccaaggttctcattacaagtcctttacccatgctttgatgtgtatacaaagtgagtgacatcgtgaagattgtgccaccctggaggaaaagaagtagtcatttcagtgcaacactttagggtcttctggaaagtaagaaattatatttatttttgccagtatgcctcttttgttcttccagtgattcgtcagcaggttgactaaaattagagccgtctgctagtcttgtcccatctaatggttagataaatcttgcactgatgttcataccttgaaggacccttttttgtggaacttcatgtgttagagaaactgaacctgtgtaaaatggagcagatccaattgctctttgtaaccttgctccctgggcccccaaagaagctagaatctcccagttttggccccgtaggtgaagatgttactttgggagtacttgtgtaacctgaagaagactgaaagtatatagcagttctcatgagggaaaccctgggattattggcctaagtctctcttcagtgcagcagaaattctgctgttagaccggcattactgtcttgacaaaaggggaaacaaagaggctactacattgttagggagccccatccatctgtccacccatctgtccatctgtccacacacccatctgtccacctacccatccgtctgtccatctgtgcaacaatgcaaggtactgggaatattgcagtggaaaagacaaaaacccctgccctgtggagccaacattgtactaggcaaaccagatcctagcacattgtcaccctagaatcaggaggactcttcctgcccagttccactgggctagacatgtaaagagaatatgtgagtaatagctaaactttggtcttactcagctaaactttggtcaaatggcaaaatacaggtgaggttcctatggacagagaaggcagatggcataatggggatatgctgagctcagtgatgcatcactgtagacagcttgagaactctaggcatgggccagcttgggacagaggccatggaagagacaggtgtagtgcgtggcacctgtagctgaggcttagatgataaccttactctgctctagcatggagaggacccgttcagccacacctgtggtcatcattgagtgcctgtttgtaaccaaggttgaaaggattgaagaagaggtctgtgtgataagtgggaggtggaagagctgatggcttatcttagctggggaggctgttctgtctcctggccttggtttcctcacctgtaaaataaggccggtatctcaaaggtcacccaggttaaaaaaaaaaatcttaactttgttgagtaagaatgtaactggttgcctctttgatctttgatcagtgatccgcatgagtggagagaacctgacttttcctggtgcctgctgcctttggagtgagtgcaaaatgtccattttgctgatgacaggctccctgttggcatgtacagagaatctcaggcagtgtgagagtgtagtagccacctagcaacattgggtctttgtgcgcatgtccttgtgatctatcaccatgctgctgctcatcttgatctaagatgcattgccagtctgccctgcattgactcagctgagaggcaaaactgggcagaaaagtgggcttctgcaactggaaccccaaaagcctgggcagagctgacccgtattgccttgaatccttgtcttgggtgttactggccatggttggctctccttaagaaccgtcacagaagaaagtcaccaaatgtctgtctgcccatcaggagctctgcacttgatctcagctaaaaggctgagaagagattcatcaggagctctgtagccttcttgataccagcagtgaatctttaatacatgtcttctctaagagatactgtctgttctctctgatctttcccatgcccccttcctctcccttcttctaccttaatgaaagagcaaaacggctaattatatggaaacaaagattgccaaggtttgtattaggatgaagtgtgtgttccacctatgatagtggccaaatcttccaaagtacatcatctgacattttagaatacagacttccctttcatagcaaacctgtattttaatagcttgtggttttaaaaatatcatctaaactcatgaactaacgcattcttctcaattatatcccaactctaccatcatcttctctttcttctccttaacttctctggaaattattggaatctgcttttaaacactggggggattgtatattatagttgtttaaaaatgaatcaatttaagtttgagcaatgtggtaattcaaagcagttttaggtgttattgggattttttataaagagcattcctgagcctgaatgaagcagtcagttttcctgatgagccatgagcccattgcattaatgtttgagtctcctggtgctcatgataacgattaaggagttaatgttacctctgccatgtttaaacattaaccaaagggcttcctctgctattatctgttatcaacaattacttggaacattttctggcagtggagctttgtttttcctccgaggagatgctagaacaggatgagaatagacattaggccacatcaaaggaagattcttgattatgtccaaagaaactctggccttgtgggtacagagagtttgcctccttaatattttgtaaactcctatcacacccccacccccaccccaccccccccacacacacacacacacactcactctctctctctctctctctctctctcccctccctcctccctcctccccctccccctcatctgggtctgaggaagagggctgcagtgattatttcattgtatcatggtgagtggtacctcttttcttatttgggatactcattagagttgctcggtggagatggaatgatggtggggtgcagttaaacatggctgagtgctttctgcttaaggacctgatgtattaatgctctccaggtcattcatatttgggggaaggaacaaagagggtactgctctactgcagatgtgttcatttgcttattaacaaaaggctgggtgacccagaaacttaaaccctgagaacaaaagtactttccagcttccaaatgggaagatcttggagactcttgagtggctcctctggagtgctttctttaccacctagctgtttggagctgtcgtgcctaatagcttctcagcctagagggccccataaaattttagtctgtttctgtatagagtgctttggagtggccgtttctctctgcctcttatttactctcaaataccctttggaaaaagagctgatgaggtgcattgagacttggcatcaaaagccattcattgatagccatcgctcaactctcttggacttaaattttgttaaacaacaatcacaaaaagtcttaaagaattacccctgtttcccctgaatgttgaagtaagaaagaaaagaattactcctgtaatgcaagaagacatactcattaaaatctaaacagcgaaaaagtatatcgattaggttgggcgcggtggctcattcctgtaatcccagcattttgggaggctgaggcaggcagatcacttggggtcaggagttcgagaccagcctggccaacgtggtgaaaccccgtctctactaaaagtacaaatattagccaggtgtggtggcagatgcctgtagtctgagctactccagaggctgaagcacaagaatctcttgaacctgggagatggaggctgcagtgagccgagatagtgccactgcactctagcctgggtgacagagcaagactctgtctcaaaaaaaaaaaaaaaaaaaaagtatattgattaaaaaggggaaaccctcccatcctgttcttcctgtagatatcactgggaccagctgggtttccagtttttttttctgtgcatttctctatactcacacatggttttgcataaatgggattatcctatacacctgttacttgacttgctggcccaggacttctctgaatgtagggtatgctagatgcacgataacacagccccatcatggcttgtaattcaggcatttagcgtaagctgctgggtttcacttttcttctggaagcttcaggcattgccctgctttctggatgtgctatggttctggattcttcctttctttttctcttaatagggcttgtctaggatggaatttcaaaataacttgattctttccatctgagacacaagcacacaaaccctttagcagaaggtttttaaggttgcctgtgtacctgccctttgcccctagaggtcccactgtgagtgccccagtcacatgatccactctggccttatgggggcagcccaccctggcgcccgtgtggtgaagcctactcgttgtcaggtttccagtcattcctctctgcccttagccctgttgttctgtggctttgctttctgggtgctctgcccatgtcctcagttcatttctctcattccgggttctttgcctgaaatatcctcactaggctccactctttggggtcaagactgctgtctttgtgcacttggaggctagcctgtctctgttgaagtaatgtgtgggtagggtgcccacaccaacatccctgacacagatctggccagccaccttggatcagcctgctgccttctcccatctcctcttagatttgttcagttccaccctttattggctgcagaaaatgattctctacaattctttcactgtggtttatgatagaatccattttcttaaatctgatgtaggatcactttccccagcagcaaggtaattctcttagggtcttcaaaatggctcccctacccgaattcccgaccatcccactaactcagagggtggggagaggtgagtagatgatgcatttgcttcaagaagtgttgcctgtacttcccatccatcaccaccagggcatattgaacccctctggcaggctcttctggtgccctctgtgatgtgagaggagttcgggggtgcagagtgaacatagtcaaggtaatttaggaagctaagctctccatgttctccttggcacaggtttctctgagtcagttggtcactccctcccaaccgccatagttttgtttcaccttggggcttttattgtgaatctccacttacggtgctcctaacatcttgcaaaggtctttcagccataggtccctgatcaggaaaaatggtctcctctctgcactccagttttattctcctaatcctctctggctgagagtcctgacctgactcagccacgccccagagccagagccctggccacttttccagcttggtccatctctcatctctgcctattcagcctaggtgtcgtgaccatcatgcccacccagcatgccaccctgtgtggtctcctgccttgacaaggtgtgtcccttgccctggagtacatcagcaggcaaccctgactcctttcagctcctagtgccccggtacctctcctgggatcctgaggtccactctgctggatgccctggcagagcagcaggctcctgggagcacctgggattgtggcccctgcttcctgggcccaggaagtgccctgagtagctacttggtggtgggtgggttacttctgatccgtttatatttgctgtactccagcccaccttggttttttcatccacagagtagaaataaattaagtggctctaagaagtagtgattctttttttaaggttggatttctgtgcttttcttaaccatggctttcatagttttgctaatagacaaaaacagtccctcgactgcctctgagagtagagctgaaataaaaattctaggcgtcttctacagtagctggagtcctgcactgtccaaggagtctcagaatgtagtaggaggggaagaagctggggattatatatctacctggaccatggaacgggatcaaagaagggcattgagcggccatcccaaagccagggcttgtaacttaacatgacacctcattcatctgagctgctactgcatacaggtttaggattctttttaaattgtgcaaatgagtctctatcttttaaactcttagctgtcatgccctggctggtgctgttattataaaattgagactggaggccatacatttgaagacgaagacagtaatccgctgccaacctacttctctcttataatatatatatatatatatatatatatatatatatatatatatttttttttttttttttttttttaacaaaaggaaagaaaaaaactcatgccagacttgtttgtctgagatttatcactgtagggatcccagagacccccatggaagctggctttagtggtggctgcggctggggactggacagaacaggtcagtgtgagcttgaactagactgcgcctgcctcctggtgcacgtactgtgtttgggcatgtgttggctcttaaaatgctgttcatccatcaacatactgaccccttttgcaagtttcattgttctattattgtgactataaaagtggcacttgttacaaaaccagtttctgtgatctagaaccgtgttctcaaacttgcatctatcagaatcatctgccccacctctagagtgtctgatcagtagctttggggtggggcctgagaatctgcatttctaacaagttcccagatgctgctgctactgcagctgacctggcaaccaccctttgagaaccactgatctagaaggtacaaggaaatgaacatcgtcttcagtcttaccactcgggagagaaccactgttaacattttagggtataatgaatatattcatacatatgtggacatatttttaaaaacaatgatagttttgtgctgtacatagcgttgctttttaaaaaaacaaccttctttcttttggaatagttttagatttgtggaaaagttgcaaagatagaacagagggctcctgtatacccagcacccagtttctcttactgttaatatcttacactattatggaacatttgtcagaacaaaggagccaacattgatacattactgttaactccacattgttactgcttttattgaaaatacatgaatgtattttcataggattcaaatatcagaaatacataatgacagagtgcctcttcactcctaccatcccacttcctatatatttcagagtattttttatatatttatatacacatgtaattatgcacacacacccatccatcttattttaagacatgcttttttcatttaaatatgtcttgaaagcttttttttttcagtatacctagatctgcaccattatttttaatggacaacacattgttttacacccttttaaatatatcttatctattttaatctagcagattaaaggtgaggtctggcacacctcccttttatcttaaagtggaggttagagattatttgccctcctttgtggagtacttagcgtattctaggcactgccaagcacttagcgtgtattatctaacctagttatcaaaacagtcttactcataggtatcattatccctgttaacagatgaggaaactgagggtcagggaggttaagtgagcaaaaacttttgacgactttctagctgaagcaggctgtctctggtactttgggtgacatgagctgttcagcttagggtgaacattgcttggtttatggagtcttcctgagtgccacacctagtgccagaatatgaaggtgaagggtatgcttagggaactcacagtcttatagctgaggggagatgtatatataaaacaaatgattatgtgataagtattacattagagtttgtaagatgtaagatgggtttcggataccttaaaaaatccactagaagtaaggcatgtgcttggaaccatggcagaacagatggaagtatagcatcagatttggcaatcagacccgagttctaattctgaatattactgtttagctgtgtgactctagataaggcatttaacctctctgagtttttggtattaatatctcaaaataggccaggcacggtggctcatgcctgtaatcccagcactttgggaggccaaggctagcagatcgcttgaggccaggagtttgagaccagcctggccaacatggcaaaactccgtctttactaataataccaaaattagctgggatagtggtatgtgcctgtaatcccagctacttgggaggctgaggcaggataatctcttgaatttgggaggcggaggtagcagtgagccaagattgtgccactgcactccagcctgggcaacagagtgaggctctatctcaaaaaaaaaaaaaaaacaaaacctcaaaatatacttcatatgtttgttagggttaagattaaataaatacatataagaagtagctattgttgtgtttagtaaatatgtacatataatgtgtttagtatatttagcataaacgtataatctctgccacatcagttgctgagttgaaacctgcctttaaaagtccttggaaagttccggatagaaacaaggacagaacgaaatcccccggtcttttatctctaagaccaaatcctgaagccctccctgaaatcccctgtgccctcagtctttgcatcctcagagcattctcttaatgggcctcactcccatttacatgttatcctgtttgtgccgtctctcctctgcaagtactgtttctcggagggcagaatctgtgcctttcattcttgtgtcccctgcaatttaatggaagcacattaaatattagttgtagaaccagatgctgtagaaagggttcacatcctacaccccaagtcaggtggagcttacatgttatggtttttgaagagtttttttcacctcttccaaccatccttcccccactggttttttagacgttagcctttgacacccaaacttgagttttaacatagaagggccattgagcattttattcaaaaagatttttaatgaattatatcttgatatatgagtagtcctcattatgaattaacttaatcctcaggtctttcactgtgaggaaagatttatgttgatattttcccccaacttagaaaagcagaacaaaacctcagcaggcctatgtcttgtgtagccagggcaattcttaccagactgccacaggttagagaaaatgctgcccattcttttcctttcctgctcgtgcttagaggagggagcattctggcagggattctgggccagtgaaattggaataatactgtaaagaagttttggttgaagacaaggctaaatgaattaagggaaaggctagtttcttaataagtttctgagttcgtcctagaaagattggtagttaaaccatgttccatgtcaacctgaactgtctaaatagtaatcttgagaggtatggcagtgttattttttttctccttctggaaaatcagctaaacttgttagagtatgtgaaaatctactctcctagatttgaagagcaggattctttttggagggcagttacagagccacactaggtttctgctttttttttttttttttcttaaataggagattgctccctcttaagagagccaacgatttagaaaacttaatcacaggttcttcttccattcacacttaatctggtcattcagaggctcttgccctccccttcagaggctgcagcgcctgacctggggccacggaggtcttcctcctcaaccttcagaaggttcaaagggcaggagtgagtctgattctttggatagggggttgggttggatcttttaaaattaatttctgggtgtgaactgtaaaagagacgaaccagtagggatttactctcctccgtaatttactattgcagccagaagcctgatggtttcagcacccccacccagaaaaaaatttataaaatgaccaaaatgttacagaaatttatttcatggaggttgttcattttatggacagttgttccattttaagcactttgatcaccctcctgattccctttttttttcctccccctttttggacgtcagttctctggcatgtttagtgacagaagcaaaagggctgtaggaaatctttcttcatgtaaataagtacctatgtctctcctcatacttttattttcctctggcattaaaatgagaagagtagggtaggggacttggaaatcctatcactgcaaaaatggttggcttagatgccggtggtggtggtggcagccagggagggaaatcaagagtcctttgcatgtgcctgggtgcacctgcttgtttattagatgcgtggctgtaagtcatctggagtagtgcaaatttgtatttttattgatttgaattcagagaaggtttttggtcttaatttaactaatttatttatttttcattttagaaattcaatttcagcttcaccctaattgtcactactaaaatcctacatatgcaattctaagcttaccaaactgataaaataagatgactttattacttttattttttaaaatttctcgttttccttttctcttttccacttggctgaggacaaatatagataaaatcttggcctattgaagagccagtaaaatgttgttttatttttgtttctaacctgggatgttttatatctgcaaaatgtggtgaagacagacccattcattaaaaacagactgctcaactgggcaccatggctcacacctgtaatccgagcactttgggaggctgaggcgggtgggtcacttgaggcccaaagtcctcaagtgaccagcatggtgaaagcctgtctctactaaaaatacaaaaattagctgggcgtggtggcgcatgcctgtaatcccagctactcgggaggctgaggtgggagaatctcttgaacccgggaggtggaaggggaggctgaggtgggagaatctcttgaacccgggaggcggaggtcgcagtgagcagagatcgtgccattgcactccagcctgggcaacaagagctaaactctgtctcaaaaacaaaacaacaacaacaacaacaaaaacaaacacaaaccagactgcataagtcttcgacttctgaggtttagtctggaagaaatttctggtgccattttagttttgtcctgcacatgggatgtggttctttgatgcagtttcaggcctgaagccaaatgtgtacctctagcccggtgaacctctcacctgttttaggaaataattttgagcaaatcatactttctttgaggatctgaagtttctcaacaaagcttgtctgaagctatgtgatgtgacgcgatgccgatgcagagagcctggatgaggctgcacagatgtgcccaactgcctgatagcctgacttctctgaaaacctactaaaaccaacaggcggactgttctttttttggacaagaaaaaagacctggccctttcatatagcacatcaagccttggtagcaaccagaaactaagtgacaaatgcaagcttttagcccctttccttcttgtccctagaccttcatagttgtagcttgtcagtagaaagaactttggcctgggagttgggagactacctgggctccagattagctgagtgacctcgggcaagtctcttagtgtatcccaagatctttctccagagcgagagagtggaatttgattctctagcggtctcttaccctggaatcctgtatgattcttaggggtccgtgctacgtctgaggttagagatctcagatgtgaaagagactgtttgaggtgtccacttaagagctgcaaactctattgacccttgtgtctttcaactggaaaaatgagagcagcttctactcaaattaagaggtgccctcagattcccctatttagattctgtgaaccagtgataagtctcctcttctgtgtgattggtgttgcccttttgggatgtagacattttggactaaggatttagagatttttttaccgagacaggattgtatgcgtactaagatgtccttaaagctggtactttccccttttatcactaatggctgctatttccagagctgtgggctttatctgaccatcttgcaggtatgttgaaagatttgactagcacttaaaaggtatgttcagaaaatgctattttaagtgtttcttctttaccctatttcccccttgttgaacagtgcaaaactaccaggttttatgttccactgggcagctgctgctggtctgatgtttttctctctgtccctcctcctccttctgtctcccctcccccgggggtcctcccccagtgcctccccctgccccattcttgctccggtctgaagggagctgtacctttgtggttcttctgcagctgctggactttgatggggacatgcttgctgcctctacacttgcttcccttagcaaccgatcctttgacgatgacctcttgctgtttgcctgttgtctctcatgttggattatagatgagagatttaccaggctgggggtagaggcctgctgttagcacatttcttttagggttcccagcgtccctcagcctgtgttttctctctctaaaatatgaggtttggagagggtgcatgtgtgtttatgtgtggcggggatattagtgccgaatcaaacagttttaagttcatagggttgtcctagttgtgagctaattttgaagtagatgctgtggtggttactgaagctacttgatttacttctcatttttattataatgtgattaacacacatggggggggaggggtgccatttgttcctctttacactttccaagtgtttgtgtgttggcactaaacttgtttcctggtgtaatctgagctctgagaattgccaaattacctaaatctccacacattttaacacatttattttctcccaaagcattaagtttttgttttatttaaagtagcagtattcctggacatgtggctcttattttgcatggacagcttatgatgttccgtgtgtaactagtttgtgcatttctgtttagctcggtggatttgccttggacaaattagggacaaggacattgtgggacagcaagaattccaaaagaaccccggattaaggccaaaaaggaaaaaaaaaaaagccatttttaaagctacccaaagaggagagtctaaaataaaattagcaatcatttttataaaaagatacaagaaaatagatatttacacactgctggtggggagggtggcttgtagcagtacaatgtatcaagagtcttaaaaatactcataccccggctaggtgcagtggctcacacctgtaatcccagcactttgttttgtttgattatatagtctttgggggaacattttttttttctaagtcttcacagtttagaggagagctacttaaagatttcattatataaacttactactttggctgagtgcagtggctcacacctgtaatcctagcactttgggaggctgaggcgggcggatcacgaggtcaggagattgagaccatcctggctaacatggtgaaaccccgtctctactgaaaatatgaaaaatgccgggtgcggtggctcacgcctgtaatcccagcactctgggaggccgaggcaggtggatcatttgagctcaggagttcgagaccagcctggccaacatggcgaaaccctgtctctactaaaaatataaaaattagccgggcgtggtggcgcacgcctgtagtcccagctactcaggaggctgaggaaggagaatcacttgaacccaggaggcagaggttgcagtgagccaagattgtgccattgcactccagcctaggtgacaaagcgagactccatctcaaaaaaaaaaaaaaaaaaagattagcgggggtatggtggcacacacctgtagtcccagctactctggaggctgaggcaggagaattgcttgaactcaagaggtggaggttgcagtgagtcaagatcgtgccactgcaccccagcctgggcaacagagcgagactccgtctccaaataaataaataaataaataaataaataaataaataataataatactcatactccttgactcaacagtttttcttctaggagtttatccttaaaaaaagtttaagatgggctgcgtgcagtggcttatgcctgtaatcccagcactttgggaggctgaggtgggtggatcacttgagctcaagagctcaagaccagctagcaacagaatgagaccctgtctcaaaaaaaaaaaaaaagtcaaagatgtgtatctcaagacttacaggtaaggatgttcactaacatgttattcgtaatagaaaattactaacaatatctaacaataaagggctagctaaatgataatatttttgttcttatagtagagtactgtgcagacatctagattgtttgaggatacttaatgtcaggggaaaatgctcataagtgaaaaaagcagaatattaagcaatgtgtcatatgatcgtaatttaaaaagaaggaccgggcacggtggctcacacctgtaatcccagcacttggagaggccaaggagggtggatggcttgagcccaggagttcaagaccagcctgggcaacatggcaaaacccgtctctatttttttttttttttcttttttaagacggagtcttgctctgtggccaggctggagtgcagtggtgcgatcttggctcactgcaacctccacctctcgagtttaagcgattcttctgcctcagcctcctgagtagctgagactacaggggggcaccaccacgctgagctaatttttgtacttttagtagagacggggtttcaccatgttggccaggatggtctcgatctcttgacctcgtgatctgcccgcctcggcctcctgaagtgctgggattataggcatgagccactgtgcccggccccatctctatttaaaaaaaaagaattgtgtggcatacacagaaaaagaatgaaattctatccacaatctgtctctttggtaatgggatttttagtgctttcattttcttcatattccaagttcttcagtggtcaggtatcacagattgtgtatccttaatctgaaaatctgaaatttgaaatgcttcaaaatctgaaactgtttgagtgctgacatgctcaaaggcaatgctcattggagcatttcagattttcagattagggatgctcaactggtccgtataatgcaaatatttgaggatctggtcccaagcatttcggataagggacaccccagcctgtagttttataagttgagaaaacttttgttttaattgactcttcaccccccgaaaattattttgagaatattttgtctaaagctaaggacttaatagatgaaccaagacaatgacttttctctgtgtttcttcttgttgttgttagaatgtgtttgtgggtttgtgctttttaaaattaaagcccccttttttctttgtgtgagagatggctttggggtttttaagttgcagtgttatctgaaggaagttatatcgcttagcaggaactcagtacaataatgtgtcatccttctgtaatcatgtaatgatgcctgacttcaaaatgacttactagtatttgggaattggtgtttggactggttgtttatgagaaagtccaggtagaccgtccatttactaaatacggacgaatggcaagggacttgggagctttctgtttgatggtggttgaaatcactagttatggatgccatctttatttggaaatgtttgtaatttgggaagaatgagaagtgttagcagatgatggttctatgaacagtttgtctaggagcatcagagtgggaggagggtgttctggggactggggagtgggtttcatttgtgtttggcagtagctggtgatggctgttgatagttgaaagatctatggtctctgttgaggagtacttgaccatgaggttggttgagtgaggaggtgagtagctatgagatcacaacctgacaggccttacgcttcctcagccttcactgtcaacaattgcttgggaaacctgtaagaatggggagaagagaaatatagcagccatatcttgggcaggtattgagagggtagttcaaaatgttggaatatgggtaaaactagaatgctgcacttctattgggctcatcatttgggagagactagtgagggtagagttggttctcttaagttggtttagtcttttaacactttattttgaatcctttaaataagcacatatgggaatgcacaggtagatagaattttcttccactgataacttgctatcagccatgtattactgagtagtatttcattgtgtggatataccacattttatgtatccactcttcagtcagtaggcatttgggttgttttcactctgtttattatgaacaatgctgctatgaatgttcatgtacagcttatggacatgttttcatttctcttgggtatatacttaggagcggaattgctgggtcatatttgccactctgtttcatgtcttgaggaattgccagactgttttccaacatatctataccattttacatttcccatcagtagtgtatgaggattctaatttctccataccctctctaatacttgttattatttatattctttttattatggccatcctatattagcaggtatgaagtgatatctcattgtggttttggtttgcacttccctcatgcctaatgacgttgagcatcttttcatgtacttattggccattcatataccttctttggagaaatgcctgtttagatcatttgtccatttcaattgggttactcattttgttattgaatcataagggtagttacacttttaaagtgttggatcacaaagagatttgccatctgagaagttagaatcaaacatttaaaattcatttaagaatggttaaaaacacattacatgttaacaaaaataacttttttttttgagatggagtattgctctgtcaccaggttggagtgcagtggcgtgatctcgactcactgcaatctccgcctcctgggtccaagtgattctcctgcctcagcctaccaagtagctgggactacaggcgtgtgccaccacacccagctaatttttgtatttttagtagagacggggtttcaccgtgttggtcaggatggtctcaatctcttgaccttctgatccgcccaccttggcctcccaaagtgctgggattacaggtgtgagccactgcgcctggctacaaataacgttttttatttaaaaaaaaatttttttaaaaaagatgtggtcctgctctgtcgcctagactggagtgcagtggcacaatcatagctccatgcagccttgaattcctgggctcaagtgatcctgctgccttagcctcccaagtagctgggactacaggcatgtgccaccatgcctggctatttaaaaaaaatttttgtagagaccgagtcttgctttgctgcctagggtggtctcgaactcttggcttcaagtgatcctcccaccttggcctcccaaagtgctgggattacaggtgttggcccagcaagcctggcctaaaatatctttttgttttagaaaatatagtgagaaaaatggccttgttttatatatttgcaaatctctttaatgcctggcttagtaagacagttggattcttgcatccacttccgtacctagtctgttgcaatatgctttggttgaagtataactaagaaaatctagccttacacagatatgtagttggaaaagggaggagtattttatagcctgttaagatattagtaattatgagtattctttgatactatatctaaactggacaagaggtagtttctgaaagattagttgcaatgtagaatctgaaaccatgtcaatgaactattcctactgtttcactttgaaatctattggtctctgttgcattttgaatggatcttttactaatgaatgattttgtattatcatctcatgcattggtcatttagaaaatattgattcacttagtcatgtagctcttccaaatactaacatttcattatacagtacttaaaaattcacatttaattaattaattaattatttttgaggtggagtttcgctcctgttgcccaggctggagtgcaatggcgtgatctcggctcactgcaacctctgccttccgggttcaatcaattctcttgcctcaccctcatgagtagctggaattacaggcacgcgccaccacgcccagctaattttgtatttttagtagagacgggtttcaccatgttggtcaggctggtctcgaactcctgacctcaggtgatccatctgcctcggcttcccaaagtgctgggattacaggtgtgagccacagcacccagcctatttatttatttttgagtcagggtctgactctgttgcccaggctggaaggcagtggcatgagctaggctcactgcagcctctacctcctagactcaagtgatccttccacctcagcctccaagtgtctagggctttagctgcatgccactgtgaccagctatatttttttattttttttttatactgatggggtttcaccatgttgcccaggctggtctcaaaactcctgagctcaagcaatctttccaccttgaccccacaaagtgctgggattaagcgtgcaccactgtgcccggccaaaaattcacatttgttcccaacagaaaagtctctaagtatcaggattctgtcagactcatagtgataggtacacatttcccaaaagtttaatttttgcttgagagttcaagttttatcattggcaaaaaatattatcaattgtttccttgaagtgttagtctcatttcattcctttttgagaaaatgcctgccctgcactcatctatataactgtactttaaggtcagttactcgtttaagtaaaaatggtgttccgtgaaaaaagttgactagtttggcttacagctaacaatcacacaagtattttgtcttgaggcaaccactgtgctttggtatgcagcagaagtgctttatgcgtatttaaccatttcgccacgcagaattttttttttaatgtactcaagggttgagatttaataaacttaatagtttttattgcttcatctgcattgcttcatcaacattcttaaggaaacttttatttcaattccaagtatacaatgatcaagagtgcagtttggtgtcactgctgtaattcttgcaacagtttttcccaccactgcttttgtacatgaatcagtgcaaatgtcagcagactgtaaaaggctaataatgtctttgtgttattacaaaaatggttttgccctcacagattacctgaaaaggttgaaggacaaacctccacccaccgccccctgccctgggcttgcagatgggatgagaaccactgggctagacagcatttaatggaaatggggataaaattgttttgaaggtgcttgctgctctgttgtctgagactggtagcataaacttgcatggtgatagcagcaaaatgtgtatagtgttgtgtaccttgttgcgttgttctttccagtctttagcaatatgcaaaatcacaaagcactaaccactgagactcctttgaaaataaactgcttcctcattttcttcttcctttcctttcctttctaacaagaaaagcacctcttcaccacctaccttgcaaatgtgctgtttcccttatttcatgttttgagttttaaaaagacagtggctctttagggccttcctccatatctctgtttctgaggatactccttatacttagaacgcttgactgatgtctagttcaggcccaggccagtggctggcaatgacctcattcttgccatgtaaatccttactgaatggcatgagactccaacttagcagttcatggaattgtaaggtgagcccagtttcccagccaattatgactccatctaaagccgtagctgggccattaatgtattttgcgccttgtcctcttttatatcttgccaaactctgagagtctactgtatagctactggcaacaggcctctgccaaaacagtctatgaatgtatcattttacacctcatttttccttgtttccccctgtgatggcaccttgcctgtgtttctctctcccacatctttctacccacttaaaaaaattattcatttaacttattcctttattgtggtattatagacttttggcttctgtagttatttagtgtgaaagagatactgaagaatgaaaatgctaatatcttcttatagcgcccttcctttttcaaccactagtggttctcctaagggccctcttctgggttgaattgtgtccccccaaatttatatgttgaaaccctaactcccagcacctcagaatgcgaccttttttggagattgagtctttacggaggtaatcaagttcaattaaggtcgtcagggtgggccctaatccaatatgactggtgtccttattaaaaggggaaatctggacatatgcacacacaccaggaacgtgccaagtgaagatggaggcagtgattggggtgatgattccacaagccaagaaacaccaaagactgccagcagcccaccagaagctaggggagaggtgtggaacagattccctcatagcccccataaggaatcaaccctgtcgacatcttgattttggacttctagtctcaactgcaagatgacaaatttcttttttacccagtttatggtagttcgttaaggcagccctgggaaatgaataccaactcaaagctgactgctgtctcccatggccctgtggttctcttgctcaccttggacctttgttctacaggtcacaccacggctggtctcccagggtgacctgtgcgcctgccatgtaaggttcctcctcagagcagtgctctgtgactgctcacgctaatgaagaatgcaaggttgaggactgtgttttctggaaagatggatagagatggtttagggactcagagataggcgactccatgtacctgctcccatcccgtttgcatgtacctcttcccctgtgttgatgagaggtattaaaatcctgctggcctccacttgctcctcttccccgtggagcaaggagcactgagccagcatgggtatatctggctttcttttctccgagtgcattctccatgggaccctcctgcgggttcccagctgaccgctggtttgcaccacacagccaggagaagtggccaagaaaagcgagctgctggatggaatgctcagggccccaaaacattactcttcgtgatagtttggttcttgccaggatgtccttgtaaaacttttatgaagatgttgttgtacttgcattggaggttgaaaattgctgttaaccttgctaagtcccatgtcccccaggaatgtggaacgctatggaaatgctctggccctcccttctggacgggtgctccactgcagcagctgcctgcacagaaagttgagctggctggctggattaagggacatcagctaggcctttgtttaaaaatatttaaaatatgtttgaacctccctttatcaacaaagaacagtttctttcagcagagagaagtttttcatttccatgttttttttttttttttaaccattttgtttggttcttttgtatattagcaactttggaaaagtgttcccattcacagtttgaaagccaagtataaaaggtattgcatcgttattttctattttgcttaagagaaaagagcagtttgcttctattaagaacataatgtttatgaagataatcttctggcttgagttaatttttttctggtgtcgagctttgacagttaaaaagcaagaatgtgtttgcgaatgtatttaaaacatctctggaattaggagtttatgaaggtatattaggtaatgagaatgagctttggaagttacaaagaaataaaagaggttcctgtgtctgagtctgctggtatgagagccaggagtattaacctatggagagtccttgactattaggtcttttgagttaagtttcaggataaggcagcatttttctaaaatccaggttttcccttgcctgcctttgtgatgatcacagtgtgtatcaggtttctgcttaacttcagatcttctttgggtatcttcccagtgttattagaaacctgagatatttccctacttacttgcaggaggagccagcatgttgcataactgcaggggccccattcatcttagagtgtggattagaccagggtgtcaagggccctaggcagcgtgcagtgctatgtgcaggtgctagcagggaaggcatggtaggtgaaggttcctgtttcttgggtgcattaatatggaattacttttcaaaacgtatcctagccatacccttgttattccatgtttttaaaccagatcattcatcttgaggagtactcggccaactctaggtacggcttttcctccagcccctcagccactgcttgacagagttgtgaggccacagcctgtgagaaatcaatctggagaattattagttgtctcttaagttgctttaaaatcgcctggaggccaaccctgaagtttaggaaaagagtgtgcttgtgtttctcctgttgacttctttctcctccaagtgttcttgtccttcagttgactctggagactggaatatgagtaaagaacatgaaagggactttagttaaacattagaacctttcaagtttcagggcttcaactgagcttagtgacatgccatcaacgaccaaggttcccatatatcctgaaaggatatttctctaaggccagttaggcatcaatcattaatcagacactttacaaatggtacttatattaggttgaatcttatgaccttgccatttttgtagatcagaaattgttggatattggcagtttcccatggttttacctggagtactctggagaggccatgtagcattgtgcttcagaatagggacctgggacctgtgggccttgtgctaggctggaattttcaccttggcacttatttgtatgtgacactggacaggtcacccactgccattgactgccattgattgctctgaaaatggggcgattgtggttccacaccatagggttgtttttaagattaaatatgtccatgtatataaagcacctaggacagggcctggcacacggctcactctgtgtgtgttttttttcatgacttcttcattcttaggaccttcacagtttctgccatatctgcgtgccagctgtgtagtcattgtcttggtcagcacaggctgctgtaacaaaataccatggactgtgtggttaaacagacatttatttctcatagttctaggtgctggaagtctgagatcagggtgccagcatggtcgggttctggtgagggccctcttcctggctcacagagctgtcttcttgctgtatcctcctgtggcgaagaaagtgtgagtgagtgagcaagctctctggcatctcttcttagaagggtactaatctcatcatgatggccctgccctcaggaccttatctaatcttaattacctcccaaagaccccacgcatctccaagtgcatattgggggagttagggcttcaaaatatgacttttggggagacccaattcagtccacagcagtcatttatttagtgtttttctttaaaagtgacagtttttaaaacaggaataacttatcttgttgattcttggatgcttttcttgtttttgtatatcatctctgaaattagaatgtcttttttttttgagtcactctgttgaccaggctggagtgcagtccatgaccatggctcaccacagcctctacctcctgggctctagcaatcctcctgagtagctgggactacaggtgtgtgccaccatgcccaactaatttttgtatgttttatagagacagggtttcaccgtgttgcccaggctggccttgaattcctgggctcaagggattctcccaccttgtcctcccacagtgctgggattacaggcgtgagccaccatatgctgggcactgtgggataatatcttaaaatctgtgaaatgtcctggtttaatttttttcttgtccactaaaagatataatggctgatggcatcacaggtttggtggaaaatggtatttttggtgtttttttttttttgttttttttttttgagacaaggtcttgttctgtcgcccaggctggagtacagtggtgcaatcatggctcactgcagctttgacctcctgggctcaaatgatcctcctgcctcaccctctggagtagctgggtctacaggcacgtgccaccacacccagctaattttttaaaatgttttgtagcgatggagtcttggtgtgttgcccaggctggccttgaactcctgggatcactcaagtgatcctccttcaccagccttccaaaatgctgggattatggggatgagccaccatgctgagcccctttaaaatggtagttttttaaaggaaatattatcaagagtttgtgctagttatgtttttccaacccatgttaaaatgaataaatgtctgttgttttaaaaagtcctcctgtgtaccaccttgcagcctctgtggatcagcagtggactcctggcctaccctctgggaaacatgaatgtggtgtatagtttttggatcatgttttgtggagcagcatcctcactcagcatagctgtgctttggttggtctcacgcactgaagtgttacttaaggtttggattatgggaaggacttttactactaaagacgttggaaaaccatatgttttgggaggctgaggtgggaggatcacctgagcccaggagttcaagaccaacctgggcaacatagcgagaccctgtctctattaaaaaaaaaaaaaagagccaggcatggtggctcgtgcctgtggttccagctacttgggaggcctaggtgggatgatcacttgaacccaggaggtccgggctgcagtgagccaggttcacatcactgtactctggcctagatgacagagtgagaccttgtctcaaaagaaaaccacatcagtaagccatcttctcgtttgcctcactaacatcctgttgaggtgtcccacaaaccaaacaggatgtgggggtgcggaggattatcccctctaggagcaagttgccccatctggttgagggagaggtggttctgtcaccagtagagcatgttgagtgctgcagagatggctggcgacggggatgtctggcctggcagatgtcaccttcaaggagggagtgtgctcattgcaggctgctttctgggatgggagtaggctagtaatgtgatgtgtggggccttccctgaaatagaaggcactggacaggcatgtagtatggataaggtagagagggtgatggatagttttggctttccttgtgaggtgggcatgctggtggcatgttttagattttccgaatggcctttgtttccatttccttttttttttttttttttttttttaaagctgcatccttttgcatcgaatgaaaccccatcaagggcatctcctaactcttcttccattctcttgtccagggctggtgttttttgtgtgtttgtgactgacaatgcagcatggagaatttggagaagctagttttgccttttctcctacaggaagagggactcgtctgcaaagaaaggggtctgcctttcagtcctttgaagccacctggtctgacaaagacagtttccctgtccctttttggaccttgagctgagcaaaaaattacttagttgctgaaagcaggtcagtgtagaggacttcctctactcctgctttgacttcatctgcaagagagctgagaactgagtgaggcatttctgcttcttgagacttctcttggtgtggcagggcttcctgtccaggaggggctccattgcctcatgccctgggtataaacagtcccagagggctttggaatcagcctgggtcaattctggaggaaaaataaggcctaataagcatggctcttttcccaaaatgtagccacaggggtctaagcagctgattgtggggtccagggccaccaggagtcttggctggcctagcatatcttgatttgttaagaaggtggatatgaattcagtctagagaagataacgtgcctattgtgcagaatgcagggctttttgttcaaggctgtctccatttggaagtagaatgacaaagcagtgtagatttacacagagcatctctgagtctgttacaacccttaagttttatggtttcgagccaggacagtacttcttacattctgtctttgtcaagggcttttgtagtcctgagattttactgtggtgcactggttatgagatgagactcatagttacaaaattccaaactgaggattatcatctagaaccactccacagttggatccttggcctcactcttcactgtgtcactcacagcacctgtcacaatgcatgtatgttacccagagggtgcccagtaaatttactgaacgagtttctaaacttccaaattgctttctgattggataataatgacagtttttgttttgttttgttttgtttgagacagagtctcgccctgtcgcccaggctggagtgcaatggcatgatcttggctcactgcaacctccgccttccaggttcaagcaattctcctgccccagcctcccaagtagctgggactacaggcacacaccaccatgtccagctaattttttgtatctttagtagagacggggtttcaccatgttggccaggctggtctcaaactcctggccttgtgatccgctcgcctcggcctcccaaagtgccaggattacaggtgtgagccaccacgcccggccaatgactgttctttttgagaccttggacattacactgaatccagtgaagtttcttgagactgtaccgtgattaggggtgggaaataaatgttgtgtgcagttttggatctggagaactttgtgggagtgaagagccaagaaggatgctttgaaaagcataactcttgctgggcgcggtggttcaagcctgtaatcaatcagcactttgggaggccgaggcgggcggatcacaaggtcaggagatcgagaccatcctggctaacacggtgaaaccccgtctctactaaaaatacaaaaaaattagccgggcgttgtggcttgtgcctgtagtcccagctactcgggaggctgaggcaggagaatggcgtgaacccaggaggcagagtttgcagtgagctgagattgcgccactgcatgccagcctgggcaacagagcgagactccgtctcaaaagaaaagcataactcttctcttctgtccacttgttaataacagctaaggttgcaattcatggaacaatgagttttgtcttttctgaaacttagtaaccacttggtctatcaacaactatttgagtagtccactgggcaggcaataaagcagtgatcagtagatttggagatggataaaacagttggttttctctcactcccctcctttaggggagggaaaggtatatgatacagtgattaagagcattaactgaggtggcgggcggtgttagagtgtctttttgaacatgggtccagctgactgtttctttgggtctatgacctcctgagcccaggttccttatcatcccatggggcagtaatcactctcctgcccacctcacagggaggaagtggatgtgacctgaattatgagttgtaaagaccgaacactggaaatgattgccactgacggagagagggtataagagtggcccttttggagtacagaggacaccaggagcctcaggctcatgactggcctcatttggttctcctcccctccttgtgtaccaatcacccaaggaaggtgattcattagacttcattagacatacttcccagttcagcttctgtcttagctcagagtaaacaagtgactctctgttcagaaccgaatgaattgcatctggtacttttagtccttgcgtcttacagcaaagattaaatggtactctggaggcttggcaagatgagactcacttcatcagcagagaagaatggagtcacttgggagggagcacccgttctggtatgaaatttctcctgatcacaagtgcttgtgaaaattaaccttttgcatactctcatccttctcaaggaaaggctgaattgcttctcaagttttgtcctgcagccttgggtgagaattctggttttgttgcaaagctagagctcagaaacaagaaagtacaaggccatttttcttggaggaagaaggcaggcagctcagcttgcatgagcatctgacccagcagcccatggctccctttgtgggaagtgtccccttagctgtggaacccaggtgggtaggtgaacacctcaccttatgactgccacaccttatgactgcccattagctgctgcgcctcctctcctccttctcttttcttctgtctttctggaggaatagtctagttcgggttggagatgaacctctggcctgggaagacctctttcaaataagattatgcccatctgtggcttaagaagttactcattcaccaaggcacatgcttgtgtctagaagtaataccatcatgttaccacagtaatattaagtagaacatacacaagtgccatttttgtaaataaaatcaggaaactagccatttcatatggtaattcccagtaactcttgagaatcttgagttgtgatttctgtcatgtagacaagtatgatggaccgaatattcatttcatttctctaccaaattcttgtgttgaagccctaactcccacggtggtggtatttggtgatggggtctatgggaggcagttagggttagatgaggtcaagagggtgggaccttcacagtgggcttagtgcccttataaaaagggacaccagggagcttgctctctctttctccccttgtatgcacaaagaacaggtcatgtgagcatgcagggaaatggtggccaccacaagctaagagaagaggcctcagagtgaaacctgcctcagtggcaccttgatcttggacttcccagctccagaactgtgagaaaataagtttctgttgtttaagcctcccagtctagggtactttgttatgatagcctgagcagactgagatacttagttcagatagaaagtgagaagctaatttgaatatgttctttatctgttcttggcctgttttctttggtctgggcaagtcattttcaaggtgttctgtgaagttcatcttcatcagaatcacctgggaagcatgttaaaaaaccagagtctgggtcccaaccccagagattctgatgggagttatatgtgtggctggactgtgcatttttcgtttatgtttttttctttgagataaactttacatggagtgaaatgtacaaatcctaagtgtactgtctcatgggtttttaataaatgagtccctttgtgagacccaacccctgtcaagatagagaacaacatgaccatcagcccagaaagttccctggtgtcccttcccaatcagtccccactggggatcttcagtggcatcccagagctgtttgctatggtggcagtagctggagagctactgttaattaatttgagcaacagtgcagctgataaatttgatctagcagggaggtctgggactgccatcctgaactcaaggttctcaaatcctgtagctcttgggtcatattgataggggctatatttttaaaaagggatagttgggcagctggttggaaggaaatggcaatgagttcatctttgggcctgtttactgcccccttttgaaactgggtcgtttccagttccgagtggggaggctgcattgttgttctgagtctcagattggagcccattacctgccaggctcctgctcattcttacttcctcttggagggatccccagcaattccaattccactagtagggtttcccagccgatcactcttccctggctgttctcagtcattctaagtgtagaagctacatcatccttggcttctgcctagtggctcacttaaccacatcatctcaatttatcatgttgctgtttatctttttaacataaagttttattatgtgacatactatctcagtctgttccttttgctctaacaaaatacctgaaactgggtgattcataaaagaaatttatttctcacagttgaggaggctggaaagtccaagatcaaggtgccagcagatttggtttctgctgaaggctcactttctccttccaagatggcacaaaagggtcaactcttcttcaagaccttttataagggcactaatctgttcatgagggaagagcccacactgtctaatcacctcccaaggccccccacctcttaataccatcaccttgggggttaagttccaaagtgcattttggagggccatatacattcaaaccatagcacatgcattatctcatttaatccagagctattggttgacatcccatcccattgggacaagaacacacatgtgatagttgagcttaaagtgtcaaaatatggacagtattcagaggaaacagtgatagtgagctggagggttctagaaagatcatgtggaggcaatggggcaagagctggaccatgaagaatggatggggcagaagatgggcaggcaggagaatgggggataaggacctcctagtgacttaggtgaatttagtatgacatcttggttttattaaataagtagcatttgatactctttagtctactttaccttttccttccaacaactctgtgaattagaaagggcagatggttaaatctatttattgttgagaaatggaggtccagaggggaaaaaaatgctttacccaagacacacagtgaaattaatggcagcctgagcttctcaccgttgctatttgagtttctccatgttacttgaccacccactggtatctgaccccaaaagaccttccttgctgacttcctgtggtattttattttgttttgcacagcatggtactgctattaaaaactaaatcttttaaaaacaacatttcctcagtagcatcaaacatatgtctttatcttcttgattcaagctggtcctgactttaagatatcttgaggagaatagggtaagaatacatgtggactttcttccttgagaatatagggaagtattagatttcagagtctgaggttaacacagtggtcaccagcctaatgtggctatttaaatttgagttaattaagtaaaacttaaaattcagttctcggtttgcatttaccgcatcccaactgctcaatagcaacatgtggcttgtagctcctacattgctggtatagaaacagaacattgccattattgcagaatgttctgttggacagcactagcctaaagctgctgtctcagctaagtgacttctctgtaacctctgactctctgtaacttctaacttgtaacttctgtgtaacctttgaccttacaaggtaggcttggagtgcagaggggtgcaatgaagttgtctgtgatacttatgcttatctcaggccatactgtaatgttctctgggtcagctctccaaaaggcacaagcagtcacttgtttttcacagagagagaacccctgattctagctattatactgactctcgtagaggtgctacaggcaggccatgataggatctggagccactgtgttatcatttcttccatagttatagatggagtgctccatgtgtcattagtcatttacactgttgtgtgtgtcagcctcaatgtctacccatgaggatacatgcctgtatttggggaggtatgcaggggaggacagctgcagcccaaaaagctcctatatgaaggaatgagctgccatactgatgcctccattcttaagaatgttctgtgttgtggttgctggtctctggctgaaatttggtacgtacattctttagtttgcaagaataaaaggctcagtgcagtgttataggcaggggtctgctcttagttcaaatgcattgaaggaagccgttttatgcacagtggcttgtaccctgaacatccttttggaaagactaaacaaagagggttattttgtgacttcaccatatacatggcctgaatggatggtaagactgttgaatggaaggttgggtagattagagtgtgctaccaaaggcaaaagggctctggccaggggcccaatactactgtgaacaggatgcaaatgatggtggtctcacaggagacacactaaacggggagttgggtgggactggagctaaccccatttaaggtcctcaagaccatgtaatgaagcaggaaacccaacacacagagtgcatgaaagcaggacacagagatgaatcctgaatgggcagagggccccagagagggagacagtgacttgggttctttaagggctcacaggctatagccacaggctacagattcacctcattgcatcccctgcttctctgtaattgccctggtgagtttccaaatgaagggaaagagccaatagccctttaggaagagatgcactagatgaaaatcacctgattaaaatattgctgttaatcgcaggagaggggggtagggagggaaaaaaaccacaggctcaagcgttaaaagcaataaattatttgttaggctttgccacccagtatgaccttgggcaagtggcataagggccccattctctctgatcctggagcagggggaatgcctgccacctgcctacctcttgggggttttgggaggattaatgacataatgtctgagctgtgctttgggctccttggagacagccactatgtatcaggaattattagcacaagctaggacagtttcttgactattctttacctcattaagctacctatgcctgattacatctgcttataaaagttgctgctcaaagaagagtggactgggaaggtcataacccaggctggatctgtcctggttggtttcattaaagccactccctaaacccacactcatcagcaacagggcaccttgaaagcttagcacagtacccagcatctaatgccagagacggatggttaaaaagaaaagaaagaagaagatcctgtggactttttgcacttctgtgttttgtgttactactaccaacccacctacattctagtgcacctaggggagtgactgccaggttgccggggatgagggacaagctccaggagtcttcagctactcagtttttagaatgagtagctgtcagatggatggacaggttttttcagtgtcaaattttgaggcaaccgactaaagaaaccaggcggctctaagttcacataccaagaaacctatattgattgtgtttctaagtgagggcaagtccatgttgtatgaatgtgtattatgtgtaaaagacacaaaaaagtatattcagtgtgggtctctatcctcaaaggtcttcatccagttggataaatttgacatttattcctagaaagctcaccagccttgatatagaccaggggagaagtcagattaggggatcaaagcacttcaggtcaaaggattcagaggctgagcctgggccaggggcagaggggtgaggggaacaactcagccacaacatcctcgagtgtatccagaggccatgcagacagaggcttgaaccacagttcacaggaggctttcaggtacctgtgatcctcctggaacaggagaggacaggaagatcctaaggtacacttcaaggccatctcccacccacctcctatctcttgggaggctgtcgtgagacagtgtctcatcacccctcaggttctgatgaggatgaacttctgtactccagccccctcagaatagagctgcagaaggtaaagctgcttagctacagtctcaagtggactcctcagcaacagggcatcccgcagctcacgctgcggtcatctggccccttctgttccaaggtcataatttttggtatgaaggacaaagccgtggggagctggcacctttggctactctttcttttgctgtctatgtaagtaataaactgcctgaatccaaaagtggcttgtgatacctttaccagccgaattagtaaggtcttggccttgccttgtctcgtatgcttgaaaagagggtgtgcccaactctcacctcaactgcgccaaagctttaggccaaaaggatagagctggttcccagggcctgtcaaaagagaagggagcaggaccgagggcaaccagcaaagctttagacccatgcagaccagtgccacctggctcagccatcctagcacagctggaattctttccatctttgttgcatcagccacacacgaggacactaatactgacattataaggttgttgttaagattggagataatgtatgttatacttccatagccgtccccgacacaactactaaaacagaaaataacagccactaacatttactatgtgcttgcctcgttccaggcactgttctgctagttttataggctaactcatctgacccttacaactacctttgaagtagatattctttttttatgtagatgaggaagccaagttcagaaatttgctcaaggtcacatacaagttagtggcagagctgggatttaaacccaggcaggctgtgagcctgggttcttaaccaccctgcctcagtggacatcagccacgttcccacactttgctgctgaaaagaaagtaacattttatccagtctaagtgctgagaacagttctggtctcctatatcttagtatcaggttgagcctgagtagaaggaaacaacaagacagaagggctggcagggatctagatagagaagactctgaaagtgatgagtgatctggtttgcaggtggtagaatatgtacttggtttgtagttaaggagaaggacaaacttcaaaagctgtctcataagtcaaaggccccaatttaggaatacgcaagtgttggtaatacatttagccaaatgctggacagaataagctagatgtgacagtggacatgaaaatgccaaattcagaatggtggtcacattttgtaggaagagagagagaaatactatttttcaggctagtatttgatgtattgttactgttttatacctcaaccccttgatttcttgaaacagtgtaaacttggtgactttactgcataataaatccacccattgcacctacattgcaagcaaactccacccactccataaattggtgattttcccgctgcatctcctgtctactttcagatagttttcctaaagccctgactggcaaaagcctaattccgccctctgcaaagatctcaggtccttgtctaacgaaaggggaaaaacattaaaaatgaaatgtttgaaatgcaacagagtgaacagagtgaaaactactgcctatagtcatgtgtcgcataatgacgtttcagtcaacaacagactgcatatacaacagtggttccgtaaagattataatggaactgaaaaatttctatcactcagtatttactgtattttttatgttagtgtactcttctacttattaaaaaagaagttagctgtaaaatagtcccaggcaggtccttcaggaggtattcgagaataaagcattattatcataggagatgacagctcatgtgtgttactgcgactaaagaccttccagtgggacaagatggacacagaagacagtgacattgatgatcctgacattgtgtaggcctaggctaatgtgtgtgtcttaatttttaacaaaaaaagtttaaaaaagtaaaaaaaaaagttttgatagaaaaaagcttatgaaataaggatataaagaaatttttttacagctgtacaatgtgtttcttattagagtgttattacaaaagtcaaaagttaaaattaagtttataaagtaaaaaagttacagtaagctaaggttaatttattattgaagaaaggaaagtattttttataaatttagtgtagcctaagttacaggcacatagttttaaaaatcttttttttttttttttttttttgagatggagtctcgctctgttgcccaggctggagtgcagtagtgcagtggcataatctcggctcactgcaacctctgcctcctgggttcaagtgattcttctgcctcagcctcctgagtagctgggattacaggtgcctgtcaccacgcccatctaattttttcgtatttttagtagaaacggggtttcaccatgttggctaggctggtctcgaactcctgacctcaggtgatccacccaccttggcctcccagagtgctgggattacaggcgtgagccactgcacccagcctaaaaatcttttataccatattttttactgtaccttttctatgtttagatatgtttaaatacacagatatttaccatggtgttacagttgactacagtacagtaacatgctgtacaagtttgtagcctcagagtcataggctatactgtacagcctaggtgtgtagtacgctattgcatccaggtttgtgtcaccacactcttatgtttgcacagtgacaaaatcgcctaatatttctcagaacatgacccctgtcatgaggtgacacgtaactgtatttaggattaaggctttcagtgaagtagaaccgtggacagaaaagaaaagactacctttgaattgttactccttcacagatcatctgtcttctctgttagttttggaaacttgttttatcctgtattgggctgtttcactgcgacatacctaggggtgaatttatggatttaatatatcctgttgaggctgggtgcggtggctgatgcttgtaatcccagcactttgggaggctgaggtgggtggatcacttgagcccaggagttcaagaccagcctagacaacatagtgaaacccatctctacaaaaaaacaaaaactagccaggcataatgacacacacctgtagtcccagctactcaggtggctgaggcaggaggatcgcttgagcccaggggggttgaggctacagtgagctgaggtcgcaccactacactccagcctaggtgacagagtgacaccgtgtctcaaaaaaaaaaaaaaaaaagaaaaaaacacaactatatatatagtggagcaaagccctctgtttttgatctgaaaacttatgtcttatttcacttctggaaagttcacagccttcatctttctgaatagggttggtctgccaccactccaacacccttcccctggatagctatcaaagctgtgttagaggcttaggtctgccctctgtgtcactaactactatttttcttcttcctctactgcattctgggtgacttcctcagcatgtcttccagttcactaatcctatctccatctttgtccagtttggattatcatttaaaatttaatttcaatgtctgtttttcatttctagcatatatacattattcttttttaaaaatatccatgtattatttcctttctgcctgttgtgttttatatttccttattctttcttatagctataattcctttttgcatctcccataattcctaaaacatacatttaaaagtcattgtcaggctgagtatggtggctcaaacctgtaatcccagcactttgggaggctgaggcgggtggatcacctgaggttaggagttcaagaccagtctggccaacatggtgaaaccctgtctctactaaaaatacaaaattagccgggcatggtggcacacgcctgtaatcccagcgacttgggaggctgaggcaggagaatggcttgaacccgggaggcggaggttgccgtgagctgagattgtaccattgcactccagcctgggcgataagagtgaaactccgtctccaaaaaaataaagtcattgtcagactgccctattttcatttaatctcaaataaattaaccccccagtgtcgattttgttggctgtcttcttgagttagttttcttttggtattttggaaattgggtttggaaactcacggagtcagagttcgtttggaggaaatggtcttctctgtgccatccctcccccaacagccttgtgtttacttctccaaggacctgtaagcctataacaggtctcatagtgacatgtcaggaccaccaggacatacagacacagataaacttcagtcttcatacctccatgtggtcttggcccacatgcaggctgtagattgtacatgcttcttcgtaacatcctaggcttcactgtgagctgtaattgtcagatgttttcagtctcctttcatagctggggcagcctagcccaaactttggttttaagtaaggacagtggctcccatcccgccccacttgggctacttttagttcccagtccaccagaatagagctcccagcaccaccacctacattcagactcaaagcacagcgggactgtggcttcagcattcatctttgctttattctgttctgttctttttttcccccgtagatatgtttatcttgtttttaagcataatttacacctttcattttctttttgtatttgatgtttggaatggaggggagggaaactgaatcaaaaataaacttatacactgagcagaaggtgatatgtaaaggaggttaaggacagagtcaagcctagtgagggtagattattccaggcagagggaacaagagcaagtgcaaaaaacctatggtaggtaggcctggcatgtgggaggaacagcagggaggccagtgtggctggaacagggtgaacaagaaagagactggcagaagagaggggtcaaaggtcatggcaggtcagacacaggattttccagggcttcataagtcagctaggaagccagtggtaacttgcacagagtagtaacatggcatgacttatattttaacaggattgctctggctgctgtatttgagaaaagactggggaaggggcagtgtcagggagtggaagagttgagggagagcagttaggagctctggcagtaacccagaggagaagtgaagggggcttggtacagggtggaagcaggggaggtgctggaaagtggttgggttctgaataggttttgtaggtaaagtcggcagaatttgctgaagggttggatgtgggtaggggagaaaggaagcaaggatgactccaaggaatgaaatgccattacttgagaagaggaacatgacagaaaaggtttgttttggaggaagctcagttttaaacaatgaaatgaaaattagcccttcttacccgactacaaagatatgataattactgtaagattcaaaagaagactgaagactgttactcagaatatagaaagaactctgaaaattcaataagtacacaacccaattaaaagcaggtaaaagatttgaatagagactttacaaagaagagatagggatggcaaataaacacatgaaaagttgctcagcaacatcgggcatcagtaaatgcaaaataaaaccacaatgagatactgctacgtgccactagaatggctaaaattaaaaggctgatactaaaaagtgtcagtgaggaagtggaacaatgggaacccatacattgcttttggtaatccaaaatggcacagttccttcggaaaagtttggagtttcttataaagctcaacatacacctaccatgtgacccaggtattccacccgtaggtatttacacaagagaaataaaaacatttgtctacgcaaacctactcaaatatccgtggcagctttatttgtaatagtgaaaaagtggaaacaatccaatgtccatcaacagatgagtgaatgaaaagtggttcacccatacagtggaccactactctgcaataagcagcaaaacactgacacatggatgaacctcaagaacataatgctgaatcaaaggatccagggttcttcccttccccccaaaaaagagtgcatgatacatcatgtttccgtttatgtggaattccagaaaatataaaccaacttatatagtaacagaaatcagatcggtgatagtctgggtatggggtggaagaagaaatggactatcagggaacaagaaactttctggggtgatgaaaatgctctgtatcttgatagtggtggtggtttcacagatgtctgcacctgtcaaaactcactacacattgttatcagtaaatgattagtttattgtatataaacacctcaattaagtctgtgtttgttttttgggatgtggtggcacaagcctgtagtccccgcaagttgggaggctaaggtggaaggactgcttgagcccaggagtttgaggctgcagtgagctatgatggtgccactgtaccccagcctggacaatagagcaagaccctgtctctaaaaaaatgtttttttttttaattactgaattcaggatatgaacaatgacagcattcttaaaagagagtcaacaagtctaccatagagctctatgacccaaccaaaagtcatagtaattccagtgctgaccacttgattatcaccagcagcctcagttatgggcttttaattcataaacagatgacttgatgaagaaaaaagggaactttactcttctgattcaggtatggctaagaaccaggccatgaaacacccaaggacctaagacacaatgcccttttaagacagctagcatgaaagtggttcttttccatgcctcgtacgccctaattgtggtagaataaagactgacatcccacaggatgtaagacgtgtgtttattaaggacatcgacttgtgccatctcactcaggtggggctggcaccattcttattttacagatgaggaaacaaccttggggaaataaagtaattgcctggagtaatggagctcagctgcattcttttttaaaaattaaataagaaatttttaagagatggtctctctgtctgtcattcaggctggagtgcagtggcgccatgataggtcacctgtcaccttgaactcctgggcataagcaatcctcccacctcagcctcccaagcagctgggattacaggtttacaccaccacacctgcctaagtttttgtattttttgtagagacagggtttcgccatgttgctgaggctggtctcaaactcctggcttcaagtgatccccttgcttcggcctcccaaagtgctgggattacagggatgagccactgcgcccagcctgttcttttcatcacatgactccactggtgatagtcttgcctcactatatttttccttttctccccatttaccatttatttgcataattctttaataacagctttattgagatataattcacataccatataattcacctatataaagtgtataattcagtggcttttagtatattcagagttgtacaaccatcaccacaatctattttagaacattttaatcacctcagaaagaaaccctgtaccttttaactctcactcccctgtcttcccattcttctacctccccagtgctaggcaaccactgatcgactgtctctgtcctattctgggctttcatgtaatagactcatataagatgtggacttttgtgactagcttcttttactcagcatattctcaaggtttattcctgttgtagcatatatcagtactctgttcaattttgtggccaaataatattccgtggtgtgggttaaccacacttgatgtttccattcatcggctgatggacattcacattgtttccactctttggttattaggaatagtgctgctatgaacgttcatgtacaagtttctgggccatgttttcttttctcttgggtatatactcaggagtggaattgctgggtgtcatatggtcactctatgtttaagcctttgaggaactgccagactcttttccaaagtggctgctccattctgcgttgccatcagcagtgtttgagggttctaattattccacattctagccaacacttggtatgacatgatgtctcattatggttttgatttgcatttccttgatggctaatgatattgagcatcttttaatgtgcttgttgacatttgcatatctcttggagaaatatgtattcagatcctatgcccatttttaattgaatagtttgtctttttattgagttgtaaaagttcgcatacattttcttctgtgggttttatacctttaaattattcatttatttattcttagagacagggccttgctgtctccaggctggagcgcagtggagccatcatggcttaatgcagcctcaaacttgtgggctcaatcttcctgcctcagcctcccaagtagccaggattacaggcgtgtaccaccacacctggctaattttttaaacgttttgtagagacagagttttgctatgttacttaggctggtctcaaactcctgagctcaaataatcctcctaccttggcctcccaaagtgctgggattacaggtgtgagccatggtgcctggccttttttacactttcttgatggtatcctttatagcacaaaagtttttaattttgatgaagttcattttgtctattttttccttggttgcctatgcttttggtatgatgtctattgccctactttttgcatgagaggtacatgggcctctttgtatctgaacatcagaaataaaagcaggatgggcaggatcaggactgcccttcagatgaggttacatgactcttctaaggtcacacagaagaggcagtactgggatccaccgtgggccagtgcaactcgaagcccttattcatcatagcacaccacagcatagcacagcatcatcagggagtggagaatgagaggttctgccttaggcccttcactaaagtgctcgctcttaacactgtgttgagaatccccttctcagaatggttacttggcaaatgttgaattatttctttcatttttgtttctatgtttttccagtgaaagaaatttaaaaaaaagaaaaaggaatgaacttaaaatcttgactggagggtaatgaacctgcctctcaagggcctgccttcctttgcattcagaaaactactcaaggttacaaaaaaccaatacatcccactggttccttgtaagaaattctccaaatatcaggaaatattgtgggaaaggaatgcatctctctctctctcttttttttttttttttttttttgagacggagtctcgctttgtcacccaggctgaagtacagtggcgcgatctcggctcactgcaagctccaccttccgagttcacgccatcctcccgcctcagcctcccgagtagctgggactacaggcacccaccatcatgcccggctaattttgtttttgtatttttagtagagacggagtttcaccgagttagccaggatggtctcgatctcctgacctcgtgatccgcctgcctcggactcccaaagtgctgggattacaggcatgagccacgatgcctggctggaatgcatctctttgacaatgcatgttgccacttaatactgccatttgttacttttaaaccgtgttatacatagagccaattcatgggaaaaagccctggttagcttcaaattttggtcacctgtcctgtcagcagatgcatatacattttataattgttttcaaactcccgattaaacaacattacagtaaaggagggctcagctcttaatcactgttccttgcctggtgtccagccacaaggtcattgcttagcaaatgttgatttaaatgagtagtagaatccaaaaaagaaaaaatctcctactattcttactctccagtccattaagtttgtaaattctttgtttccttttagttttcatctagatacagatgtgatttttatttatttttatttttttgagacagagtctcactcttgtccaggctggcgcgccatggccagatcctagctcactgcagcctcaaccttccaggctcaagcaatcctcccaccttggcctctcgagtagcaaggaccacaggtgcatgccacctaattttttaatttttgtagagacaggggtctcactgtgttgcccaggttagtcccaaactcctgggctcaagtaatcctcccatcttggcctcccaaagtgctgagattacaggcagatatgatttttaaatctgtacattaatttttctgaaaattctgtacatctaatactatgttgtcttcattattatcttactgtggtgacattacatcccataaattatgcacattgtttttattatatagtctttgggggaactttttttttctttctaagttttcacagtttagaggaggactacttgaagatttcatcatataaagttactactttggctgggtgcagtggcttacgcctgtaatcctagcattttgggagtccgaggcgggcggatcatgacgtcaagagttcaagaccaggccaggcgcagtggctcacgcctgtaatcccagcactttgggaggccgaggtgggcggatcacaaggtcaggagttcgagaccagcctggccaatatggtgaaaccctatctctactaaaaataccaaaattagccgggagtggtggcggacgcctgtagtcccagctactcggggggctgaggcaggagaatcacttgaaccagggaggtggaggttgtagtgagccgagatcgagatcgggccactgcactccagcctgggagacagagcgatactctgtctcaaaaaaaaaaaaaaaaaaaaagagttcaagaccagcctggccaacatgatgaaacctcgtctctactaaaagtacaaaaattagccagacatggtggcgggcgcctgtaatccgagctccttgggaggctgaggcaggagaatcgcttgaacctgggaggcagagattgcagtgagctgagatcgcaccactgcactctagcctgggcaacagtgcaagactctgtctcaagaaaaaaaaaattactactttgaggttatttcctcggggtctgtttgaaaaatgaaattgtgggggaaggacataacggagcttgggcattgtctcattgccagaccgcttccccccaaatttgagccaatttgcagcatggccagaatgtgtttgcccaagttgggtttagagctggtttacttggctgattttgctgttgtattcatcaccaataagatggatgatgattctgttttcttactataaattagttgcatatatcccttaactctcagtcatttcattccttgcagtgtatctttgttctgtacctgctcatatggagaagttcaaaaaatacattagtactttctgccccactttgtcactatctagttcactaattttcctaaaggaattgacttagctcatgttgcttcatcatttataaacatataaatgaggcagaggttgcattgagcgaagatcatgccactgcactccagcatgggcaacagagcgggaccctgtctcaaaaaataaatgaataggctgggtggcagaggtgggtgggttacttgagttggatccaggagtttgagaccagcctggacaacatagtgagaccctgtctctactaaaaatacaaaaattagctgggcatggttgtgcatgcctgtaatcccaactacctgggggactgagtcaggaggaagtcctggctgcagtgagccaagattgtgcctctacacgccagcctgggtgacaaagtgagacccctgtctgaataaaaaataaattaatatagctttggaattttttttcacttatttttctagtttcagttcagcatcatgtagtttgaatgatttgttgttttatagtattgtatttcatcttaatttagtaactctttgatgtgtttaagcacctaatccttttcataataagaacgatcaaatgtcctttataagttgccttgcaatttgaagtaaaactgtgtgagtgaatttctgtgtagagaacaatacttgtcatctggtaggcacatgagtcactctgagtcacttcaagaatgaatttagaattaatttagcttaaggtttctatagtctactggatacttaaaaaaaaatttaacttacgaggcatcttatctatttgaaactagcaacagccattctaagtgagggtttgtaaagtcaggcgtgagatatacatggggccatatgtaagttttaacataattctctgacaaaatgaaattctagggcgtgggagatactcaagagaaaaggtggatttgaaatgccccctgcttccccaagtttctgacaggtcacttctcagttgtgcatttggtacagaggaatgaaataggtatagaggctctttttggtttttctcaaaaaaagtgatacccactgggggagactccagccgagtgttctgaaagccagagtcctcagccgagagaactccacagtcttcaggccgttcccagctggaattctctgtgaaacagcagcaacagccagcagctttttggtgtctggggtagtttctgacccatcacagttcccttcattgctatgacaacagggagaataattattcaggttctgtttgattctagatccagaaaaaggtttaggctctttgttcaaagagcaaaagaattgtccgtttctttgtacatagaagagggaaaaaaaatccttatgattcaagagaaaaatgggtgcgtctgtcctttttcctttctttcacgtaaattataagtcttggttctagccaccacaccttttaagaaaaggtctgggactgatgtgagactctgtaccacagcgacaccctaccctggccgacagtggcaaaagaacaaaaggaaggaagtttcccttttaaatccccaggaattttttgatgagataatattacagagtgaaatgtctcgtcctcctattagtttagtatttggcttctgtgtaacagtaacccacttagaagcaggcggctcttttgaagttattttaaactctcagcctagtgtagagatttgtaaccttggataaaagcaccactagccctagtttcagttttgccctttcagacatgtggaaagtgcaccagtatatctcaaggattttgtactgaaagcttcttaaagagctggtcttggtttcaaagtttggcttgatgtaccatactcaagggaacatagttctttttctccagatatttaaccttgtctgacatcgtcttttggcttcgaagttcccctagcttctttgtccattaacaaaacatgaaaccacatgaaaccatgatagtcagtctcactgggctctgaggaagttgaagaaagttcatcttcatatttaaacataaaaccagttgtttgatacctggtaccagagatggccaggtatatgcattgcttgttggtagcattttgccttagtaactattcagaaatgcaagtggaatgttgagttcctcttctagaggttatatctgtatctgggagaaaattggagcttctcagaacaatcaccctggttattgtgtctgccgtctctgtaacacccaaatctatatcacactctgatgccacctgggagctatttttggttgcgaagggtggtgaaagctgctggttctttctcttaccgtgtgtccctgagtcatccccagcccacgtcctggatggctcccagaacagccgtctcagacgaagtctcccttcagatgtccactcctcagtgcagggggcctgtggggtctctcttggtcctgatgaaatccttctctgccttttccagtgagaaggacccatagaatctgctggaacacttggagaaagggacttatttccagcagtgcataaaatttttgattaaaataattcacgtgtctgtttataaaaagacaaagcgtacatcatggtttataataaaaaagagcattatcttgtttcaccttcaccacccctgattgctattcccagaggcaaccattttcaattctttagtggcttcttttgtcttcatctctgtgattctttctaaatttctgtaactcttatagtcaattgcagaataatttattgacctcctcctgtagaaaaagattttgcttttcactcccctcttctcattcctgcattcttccaatgtagttatatcacataggtcataccctgattatgggttccaatcctggtgtaagtttttgttttttttctggagttaatcattgctcccctcaccctggccctccattactttagtttgctgtaactatcacgtgtcatcctcttgttcagaactataaaactctcctcagtaccatctaacccactgggtaatgagtcatatttttgttgttatttgtttggctgtcctgtagcctcatccttctggccccatctggacctgtcattcaacaggctggttgcaaagccatcgtcctgggatttctctttatttctctaatctgtgggagtccctgtgcttggatcccatgcctgccttttccttagttttatttctttgttttgttgttgctgacagcaactcctgaggttggacgtggatgggaaaatttgagacttgcttttttggggaggacatcttctattctccttccccttctactgtcctttcaaggtgctgtcatggtgaagggcaccagtgttgtggtctctgtgtatagaaagcagtagccaccccagcgttcttgggctgctgtggccccacagcaaggccaaggaggagcagcctttgctcctataccattgccagtaaatcttttttgtcctggaaatgtctttgatgactcagtaatcaataactgtaagagctaggtctttcaaagttcatgcagcaagttaattaaatcctgacctatttgccctggtccctcacttagcagagcagagacccaagtggctcagcaaaaacagcaagagacatggcagcaggcctgcctccaggccagaggtcatttgttcagccagcagtcatttattgagcacctgttgggtgcaaagctctgtgtagggtgaaaggggacttctgaataagactgtctttctagaagcaggtgcccatcttagaggggaggctgtaggaaccagtaagcaccatacaaagcatttgagaatcaaaaagtattagttcattcaagaaagctccgtggaaggggtgatatttaagttggtcttgaagggcaaagcattcaaggcaaaggcataaaatgcaaatggacatgacaggtctagagaaggtgaaggagagagctttcccattgatggaacgtctactggtgttactatgttgatgtattttatctcatttaatccttaacgatgtctgtatttgtccatatcagttaagacagatgctacagtctccattttacagataagaaaatccatatggaaaacagataggggcatagagtgtggaagtacaggcattggagactcagaagggtgggtggagggggggaaggggaatggattatgggaaattacttaatgggtaccatttacattattcaggtgatagatacactaaaagcccagatttccccactaaacaatatagccatgtaacaaaatcacacttcaatatatacaaataattttaaaaatcaaggtttatagaaatcaactcatctgcctaggtgatgtgcctcataaaaggcagaagtgagatttcaacacaagattgcatgatctcaaatctcattccttccttcccaaaatatcccttggaacaaaataaggagtgagagggtaagagccacagtttcataataatgtcaaactcttgataaaggagtgagtaggcattttccttcagttgacttaagcaagatgtcaagtatcccaaagttattgcacaaagagcaaaagtaaaacaaaatcaaagttataacccaggacatattttctgttatatccttgcactttcattgtagcttattaattatttgcatgaagttcttctgtgaatctgccccagaagtttttcttgtcttctcatttcaagccatccttccccttagtattctctattggatggagtcttggttccagtctagggtttccatgtctatttgatttttttctttacgttttcattagtagttcttgagttcttacacacaattcagctgtttttaatcttcttaaaaataataaggcaaaaacataaatgtcaagcatctgactaggaaagccctacccatccaaatattttaagaaaataaactcagaaatgcctataacttttaaatgcttatatgctacattaagttcaaagttaacatgcttaacaccatacacggaagtatcctacgatgaattttcaatgattaggcgttcagaaccacacaggtcttatatgtagtcagtgcctatatgtcgctggctagtgttagcatgtgtgaataacacgcctggtttttacctgatgactgcagggatggtgtggaagtagtgtctagctgaaactttgggagagtttaggaatttcttacagagaaggttcttattctctacagatgattgttatccagataaggaccttgggatcttttaaaatcagaggctaataattcttttttatctttttaaaaaaattgagatgcagtcttgctatgttggccaggctggtctcgaactcctgggttcaaaccatcctcccacctcagcctcccagtagctaggattataggtgtgtgtcactatgcctggtttagggcctagtatttcttaggagaaagtagaaataaaggtttcattggggctatatcttaaaaaataaaaatgaaagtaatggtttatatttaaattataattgcagctttgtactgatttttgagaataaacaaagattgaatctcttgtgggccatgcggggatattctcagcaaaactgtataagactgtgcatatagcatccttcacttaggtttgagttcagccgggtgcgatggctcatgcctgtaatcccagcgttttgggagtccaaggcgggtggatcacctgaggtcaggaatttgagaccagcctggccaacatggtgaaaccctgactctactaaaaatacaaaaattagctgagcgtggtggcgggcgcctctaatcccagctactcaagaggctgaggcaagagaattgcttgaacccgggaagcagaggttgcagtgagccgagatcgcgccactgtgctccagcctgggcaatggagactccgtctaaaaaaaaaaagttgttttccaactgagaggactctcactttttccaaaggtctctcttaatcctttgatcattctctgtggaagctcccatgcgtgtttcttcttctttaatccttaactagattgtttgccattggctttgagtggaatccagttgttgactaataggactttcatggactctgttaaattctgcattggttgctgatttgcagttctagtttgcaacttatttacatagtttagtcactatatcatctgatattccaacaattagcaggagttcactgttggattaaataagagattaaaatgtgtaaaccggtcaggtgcagcagctcacacctgtaattccagcactttgggaggctgaggcggaaggattgcttgcgcctaggagttcaagaccagcctgggcgacattgtgagacctgtctctacaaaaaaaaaaaaaaaaaaaaaaagtcaataaatgaggtggcaagattgcttgagcctagggggtcgaggttgcagtaagctgtgatcacgccactgcactctcatctgggtgacagaacaagaccctgcctttaaaaaaaaaaaaaaaaagtgttaacattgcagatgtccagttaataggaaaggcctctgtttcacttttcccataaaatgcaaatgaaatggtatgttcatttgcattttatgcctttgcctagaatactccatccttgggacaggtcagttccctaagaatattttcacataatgactacttctgcttctctataaaaacatctcctgagctcgtaacttggagcccttgggaaaagagaacctcagggtggaaatggctggaggcctagggtggccgatgctgtcgtcaggggccagctgacagagacctgaatcgtataatatgatattcaataggtgggtcaaaggagcctgttagattgaattaacagacttgcactggagatgtaaactggaataaggagctcaggagagagggaacttagggtggaagtgggaaggtggaatggatggtgaggtaagttttctatcctctgagatgtgatctcagtggcttctttaccctccacaagagggtaaagcgtccctcccactggcactttagaaaaattccttttagttttaaaggctttcattcctgttcagaagtcaatgcccttgacggggctgatgtgttgagctgctaacagtcacccatcccagtgtcaggaagatttgatagaggagtttggaggagagtgggaaggaatgactgcttaggaggggagagagcctggcaatgaaatgtggcccagggcaccagcctgacagccccgagggacccctgggtgtgtttgaggctttcatagttcagatttctgcatgcccggacacgctctccacatgcctttcctgaggccgtgtgttctgctcctccaagagagtaagcctctggcctggtcaggcccacttccacctcactggctgcagtgggtcaggcctcggctttggcttcagctgcctcttggtttccattccttgtcttctccccgtcctccacatctgccgctctcccaagccttgtcttttctccagctgccctcgactgtccctccatttctttctaccatggccttaagtctttgcgtcatggatgttcagcatttgcagacatttagctttacctcatgtcatatttactgtaggtttattgccatgcgtgtgtatgtgttctccctaacttagcatctctcaacgtgtgtcccatgaaatagtgtgatcagattaaatgcaaaacaagtttataaacaaagggtaggaaatggtggttttagcaaaggttaaaagcctttttaaaccattggccactgcagagctttaattcacacatgtagatcctgagtccctgtgaagagtttctcagtgttatttacttgtgcaagaacctgtttttcatcttgtggtaggtagtattctgcaggacccagtttcctgaagggctgctggaattcacttaggctctggaagggtagaaaccacattgtccttcactgtgggatccccgtgttagctgagggcagtgctaggcagggcgtaagtcattcctgagtaagctcttaggacagttgcttgttttttttttttaaaaaaaaccttttaattgtgaaattcatataaaattcaccattttaatcattttaaagcatgaaattaagtggcatttaatatgttcacagtgttgtgcaatcttcaccaccatctagttccagaacgttttcatcacccagaaggaagccctgtacccattgaacagtcactccttatttgcccctccctgctgcccttggcaaccactagtcttctttctgtctcaatggttttgcctcttctggacatgtaatggaatcatacaatatgcggtgttttgtgcctggcttctttctttagtaaagttttgatatagatgcaaagtcttagacccagatgatacctatgctcctccaaagcaactctttatcattggccaaaccccataaatgtataagtaaccaaaagcagccattcatctggaaacctccaagttgtgtggccaggttaaaaataccttggaatactggttgccgttaccatgatttgacctgggacttcaggaagctggctgagctgtgctggagtgagccgggtcttgagccctttcctggaggtcagaggtgcctgagctgttgacataattggctcatccctcttgctcatcctttttctagttggaggtctcagcatttcagactactcattgtttaataactgtagaacattctagagtgggctgaatcctgcacgggcaccctggaggaaaggttgccccacccatggcaccgcagaacctccattggcccttcaggcaaattccatgagcctgaaagtttgtgcaaagttagatcccagggccctctatctcatatcttggaattcccaaggggtgggatatctctcacccactataaagacagctgctggccgccctgtgctcagcagtggtgacctctcacctgccttatgagcttgtgcaacccctttcctgttgtttcattgaattgtcaaggaactctcatttttggcctgcaccctttgccctccactcgttgctgtctctggagtccaagaataccactgctccaagaggttacctgcctgcctaaaataacttctttcagtgcacaatcttctgcctaaggacctgtaatgctgtcttggtgtccagactccatcctggtttttgagcccttctctttccttctcagtgtagacagtgacccttcctactcatcagactggatgcatccttttctcccctctatatcatctcttagcaactcctccccgggcttggaactgacctctctctctcgttttgccctgatcagtctaactcttccttctaagctcactcgaggctcagcagctgcgcaaagcctccccaaacattctagcaactcttgctgcctgcaccaaactcatgttacgcttgaataccacaggatttagagctggaaactttttttctaaggattttatctcttagtctttccctgtcagatggtcagctctcagaggaagggaagataaagtaagcaagtggtggagtgggaaggcactggattgtgaatccaagggcctggtcacctctgggtgtgccacatactggctgtgtcttggaaaagccacttatcttggatttctgttctcatctgtaaaacaagtaggggataatgtgggtgtattagtttcctatttgctgctgtaacaagtttctacaaacttagtggcttaaagcaacacaaattcattctcttacagttctggaggtcagaagtcccaaacaggtcttcagggctacattctttctggaagcttgaggggagaatccatttttcatctttgtcagcttctagaggccatcgtcatttcttgattaacggccccctcctccaccttcaaagcacatcagcctctgcttctgtcatcacatctgttctccatctttctcatgcttccctgcttcccttataaggacctttgtgattgcactggaccaacccagataattcagtaatctgtccatctcaaactcaatcacatctgcaaagtctcttgctgtgtaaggtaacttatgcacaggttctggagattaggacatagatatcttgggggccatattctgtctagagtgcattcttaggtctcttgtgtttctaacttgtcatgaatctaaagacgtatttcttccacttatttaagagcttagcacacacagtgctaggcttatcagcttcttgataagttatgtttatccctgaggatttcctcttctcagattgttattagggattctagggcctggtaccactcagtgatagaactgtgagcacaaaccttagggttgttctggtttgactgcactttcacacacagaaatttgacactgcttatctgcccatctttgattttgtgctttgcaaattttgaaaagacctcaaagaattttatctgtttcccagtaaccaggggtagcctttaaacagcctgttaattacactggtgatttctgtggtctctgcatagagtccgggatgtgtttccagatcctcttgcgtaagttgaagtagacatgttgttgaagtctagaagccaaacaatcttggatactaacatagctagtctcgtctgtaattgctacttagtgttaaatttatggtatttcacagcaatttagattggcatttatatgggaattgtgctgttttctttccctagatcctattgggcagtttccaccttggatcaccatcacttacaaggcagtaaaaaagcatgcataacatacatttataatggctctatagtgttctccccagtgctcagctcattgtgctgaaataaaattccccttgggttgaaaaactgtccccactcttaaaattttaagttttgacgttacttttggctatagcatctgagaaatacacaatatgagtcaagcaaatgtgtagcttgcctgctgaagttttctttccattttatttcctagatgcacccactgggcctatgtaataacaatgacgaagaggacttgtatgaatatggctgggtaggagtggtgaagctggaacagccagaattggacccgaaaccatgcctcactgtcctaggcaaggtaagcaccaggcccttggaatcactgtgtttctggttggtgttttccactcttccatttcagcattcctcaaatagttgattatggagaagagccatgctggcacagtgctccttcccggctgaagttgcatgaggtggggactgagacatgccttgcagtggcccaccagtgtttacaagcccagactgaaagagactgccagtctcagagcgggctctaccctcttgtccattgtgtggccttgggcaagttgcttcccctcaaggagtcttagtctcttgtctgtgaaatgggctaataatagagattcacaatactttatcttacacccttgggccagatgtttcagaattctgagatttggggggtttagaaaggcattaaggggtatagattttatattaagtaacctccaagagacatggggaggcactcagtaaccaaacacattcacatttgtatagcaaaccatagagatcttcacattaagtgggataactaaaatctaaatagcctcgtgttagttcacggcagctttgcctccagatgagttcaggtccattaagttttgctgccaagtaagttatgggaaaatgtttcggttttagagctttttttggtttcagaatggcagacagcaattatggtcctgtattagaacttacctcataggtggttaggaggtgagatgagatgcaaacgcctcacacaagagtaagccctcaataaacgtttgctgccattggctaccatcactccatttagaagtactaaaaaagactttttagccaagagggtcagcattactttgactgcagtataagatagaaataaatttactttggaaagccactcatcaacaatcttaaaatatgacaggtaacaacctgttttaaactggattttgtttagactgcatcattttgttaaaaggagaggttcagagaaggtgatttgaattttggctgggagaaaggtagtctgtcctaaggatagtggtactgactggatatcttttatattctcaaaagctgccattctaggtaccatggggagagagctggggcaaaaaactgtcctggttcctaacctcttgaggctctcttgagaaatccaggagagacaaggggtggttttgaagcagggtgctagagagggaagactttccagacttaaagtagcccctgccagtgtctcctgaaagacctttggctccaggtaccctcacaggtctaatctttttgtggtttttgcatccctcttgtcttctgaataacttcaagtcacttgtcaagttctcctgccctttagttggaaaaaataaccccacaggaattattagctgtttgctttacagttcacaaagttgaatcgaggtgttttaggtggctcaggccctgatacttcatcatttaaataattggccagagctgcttagtggtggtaggagagcaatgacccccttgagaatattttagtgttttcttaggagaaatgccagctacatctacagggtaggaacagtgctttccttgtaggtgttacgctcctaatacaacattttctcttgtactttatgcaggaattggctccttgacttcatttgctttgccccggtctggtggggctccatctttgtgtctctcgcatctataaatgggttggaacagggattacagggtcaccctatagttctcccatggtttagcggtggggaaacttgctgaagtcactcagagaacccaactatttcctcctctgcctggaacaaccatgtagtggttttacttggagagttttgtatgatttggcctgctagcctgtgatgccagggggaataaaaaaccctaggcatatattgaatcattaagtgcttcttaagtttattcactcaccaaatatttattggatgcaggggcccagaagctgagcatgtggttctacctgcttgcaagcagcagcccccacgtttctctggagaggctggtggcgggcagcatttgcacatggttagtcattgcagtttggctttgagtttacacctgaataaaatcattagcacagaagcttgggccaaagaaagacagttttgcatttgtttaaagcctgggccagtgtaggaggtgcgatgagtcaagatctctctctcttcctccctctctctcctgccgcccctctttctctcatcatcttcttaaagtgtggttgttctcagtctcaatttcattaactttgacaactgcgttttcttgttttatgagccccccgggggctggtagcaaaaaaataggttaaaggaaggcaaagttatccccttgggcagcttagtccctgcagaattcatgattttccatccatttcttggctctgaagaagcaggcagtggacagaggcagaaaaggcataggaggaaaacagccaagctagcttgggggtgggagctccttcctgtggatgttgaaacttgttgaaaacccacgaagggaggactctgtccgctgcaggcgggccaggcattcggaaaagcctgtgggagaagaggggtggcctagacacaggctaaccccctccccaccacccaccctcttcacctacccgcgtacttacagacaatgccacagggtgaaaccttgaaataagagaggatgtcctaaattaaaacacgtaaatgcctctccaagagttcaaataaaatttcattttaaaagcaaaaggcataaacttgtcacctcagtttattactgagtgcttttgaacttctcagaaaagaactctataaactcatgagagaaatatgatttatgatcccctccttctcttcttttccattctgtgggaggaggtacagtcaggatcagctagggaggcagcgttgggatgagggcaagaccccacaggggagcagcaggccagggcgccaggccaggcccagcctcagaccaggcatgggcgcatctctccagctttctgagcctctctcctgtacttaatgtggagaggctgttgtgggttccttgttcttctaatattttgagcttctgtatcatatttaaaatctttctttgatattctagttcggagagattctagttacagcattgaaaaacaggctctgttacctgtggcagtttaagtcctaagaagttaaaatagaataaaattgacatttcttagagtttgctattaagtaagggtcttggccaggcacggtggctcacacttgtaatcccagcactttgggaggccgtgccgggcagatcacttgaggccaggagtttgaaaccagcctggccaatatggcgaaatcccatctctactaaaaatacaaaattagctgggagtggtggcatgcacctgtagttccatctgcttgggagtctgaggcaggagaattgctggaggtggaggttggagtgtgctgtgatcgcaccactgtactctaggctgggcgacagaggaagaccctgtctccagtcaatcaatcagtcaatcagtcaatcaatgtaagggtcttaaaccatccccaaagcaaaggagtctatgtttatgtcccgggcatcttaaccctccaattcaatcagtgtttattaagcatcttatagagctaagaattttgaaggttgactttaatagctttacctgtggagagtctcatggcagggaacatgagaggtgctggcgtttctagcaaagcctggttggccctgattctgtaactcaaggcagaataaatgccccataaccaccaccccatgttagagaagattcttagggagaggtttggaaaacagcatgggccaggcgtggtggctcacgcctgtaatcctagtactgtgggaggctgaggcgcgccgattgcatgagctcagggatttgagaccagcctgggcaacatggcaaaacaccatctctacaaaaaacacaaaaattagccagtcatggtggtgcatgcctgtggtttcagctactcgggaggctgaggtgggaggattgcttgagcccaggaggtcaaggctgcagcgagctgagattgtgccactgccctccagcctggccaacagagagaccctctctcaaaaaaaaaaaaaaaaaaaaaaaaaaaaaaaagaagaacagtatggtcaataggcatggccttagctctctccaaggcttaatagtacaatgtggggaaattgagaaaaagataagaaagggagtttcatgtcacagagacccagccttggctgactgacctcagaaagggtacttcattcagttctcggtgcattctcctctgtgcagcagggctaatgctgcctgtgtcattgtagtgggggctctgtgagatatttgtagagcacttagctcagagcctggcttatgggaaatgttggatgaccatgtagaagtcagccatcacatgttgggtgctcgccgagtgctgagagctttacctatagcgtctcctttaattaatgctaatttgacatcctatccagattcccattttaccataagcaaatcgagtcctagagagttctctacataacctgaaattgaacagcttacaagagccaagatctgaaataagacccttctgcttcatcaatgttggtttcttctctttgcctccttttgtcttcgccagtttttctagataaaaatcagatgctcacctgggcacggtggctcacacctataatctcaacactttgagaggctgagtcaggagagctgcttgaggccagaagttcaagaccagtttgggcaacatagtgagacctcctgtccacaaaagaataaaaaaaaaaaaataataagctgggcatggtggcacgagcctgtagtactagctactcgggaggctgaggcaagaggatggcttgagccaaagagttcgagcctacagtgagccatgatcatgccactgctctctagcctgggatatagagtgagaccctatctctctccctcttccccccaaccccccgccccggccccgcacaccaccccccaccccccggaaaaacgaaaaagaaatcagatgccttttagtagtcaaaggcttggttaaaactgttagttccacataatagaaactcagcctgagctctgttgagcagaaagaggaatttgctctgaggattctgggctatgtcacagaacccatgacaggggtgctgatgcccttccacagcacctgactccagggcttggatgccagcggccccctcctcaactcttctccatccacgcatctgctttattctctcactccccatttggtaggagacgcagccccccagtctccctgggcatgaactctctgggttttgagtctgaaaaattccagaaaagggattcattggcccatcttggatcaggggctcacacttaggctagtcagctgtaccctgggggctgtcctgccataggtggggagcaaggggaagatgtgttctccagaagagagctggtggggggcagtgctgggctgtcatcctcatagcaggcccctgcagtcactaaatcatatatgtgatcatgagcttgtgggtgatgtcctcagtctatcctgagtcattcagagaaggttcagctggaagaaactcatggtctatgtgtactacatagaatcaaatcctcttcttcccctgaacacagagagtgattgtggtgagtgaaaagtgagtccacgtggactggaggagttgggcaggttttacagagtgggggttgtgtaagacagacgtacgaggagacaggatgaggtaggaaaagaatctccagaacagggcagaagaaaagggagcaagatgttcttcaaggagcattgaaagttgctgctgaaggaagaggctctcaagtgaaagagtttggtcttcattctctaaagagctgggagccactgaaggcttctgacaaaagagcaggtgttgtagaatctgtattctgggaatgttcacttggcagtggcatctattctggttggagagagatcaagttaccctgccactagatgttttgaggaacccagtggaaccaggcatctgttattttaaatgctttagtggggctcaagcccggaaattactgagggctcttcatgtttgccatctctcctttctgtttgcacatttaagcaaatgtgaaatgtaggagcaacatgtccaacagcatgggaaggtggaaaactatgttgaaagggaggagagctggtttttaatcctggctcttctgataagcagcggggaaaccaaggtacgagaggtgggtggaaaattgaaccatatggtcagcccactaacccacgtccagccctcagtgtcttgggaacttctttgcaaagcacaaatacagactctggtaaccaaaatgaccagaagacagagaaccgagtcaaaggaaccttgacttttcaaagtgattgggagagggggagcatgtaagggttaagacttgggtttagtcatcatactaacacaggtttcaaccccagttctaacccttttctgagacagggtcttgctctgttgcccaggctggagtgcagtggcacaatcatggctcacttcagcctcaaactcccgggctcaagtaatcctcccacttcagcctcccaagtagctgggactacaggtgtgtgccaccacacctagctagtttttaatttttttgtagagacagagtctcaatatattacccaggcaacaggctcctagactcaagcgatcctcctgcctcccaaagtgctgggattacaggcgtgagccaccgcactcagccccaagccttctaagctctgtgagctcctgcagtcacttaacgcgtctgtgtgtttagatgggaatagcccctaaaggagataatgtatatcaagtgttgatcacattcctggcacaaccaaaagcactaaaccaggtgttgactcttattgtccatcttctcttcctttctctctccctcctttattgtccttcagttcctttctttttttttttttttttttttttttttgagatggaatttcactcttgttgcccaggctggagtgcaatagtgtgatcttggctcactgcaacctccgcctcccgggttcaagtgattgtcctgcctcagcctcctgagtagctgggattacaggcatgcaccaccacgcctggataatttattttatattttttatttttagtagagacggggtttctccatggtggtcgggctggtctcaaactcaggtgatccacccacctcagcctcccaaagtgctgggattacaggcatgagccaccgctcccggctccttcgttccttttatcactcaaagtggtattacttaaggagtcaaatccgtagagacagaaagtagaatggtggttgctggggtggggtatggggcaaggggagttgtttaatgggtatgaagcttccatttgagaagatgaaaaagtactggagatgagtggtggtcatggttggatgacagcgtgaatatgcttaatgccactgaactgtgcacttaaaaatgattacagtggcaaatttcatgttatgtatattttaccacagttaaaaaaacaatggtattacttaaatcatttcataatatatggaagttgagagcagtgggtataaaaaaaataagcaattttttccttaagcgatggagcatagttgctccaggaaagaagtgggtgactgatgttactgaatcctggggcaaagcaaacccgcatcccatagaatgttattcccaaggagtgttctggacaatctaggtacaatgaggacagagaccaaacccttctttgtgcatcaggatgccctggggaaattttctacttacttttgaagaacaactcccaaaatagagaatttcggggaagggaagacagacttatttgttatcctctcttcatgacaaagtggatggaggataggaaaatcaaactaattgaaatccaaggctgggcggggtggctcacgcctgtaatcccagcactttgggaggctgaggcgggtggatcacgaggtcaggagagccagaccatcctggctaacacggtgaaaccccatctctactaaaaatacaaaaaaattagcctggtgtggtggcgggcgcctgtaatcccagctactcaggaggctgaggcaggagaatggcgtgagcccaggagcttgcagtgagccgagatcacgctactgcactccaaactgggcgacagagcgagaatccatctcaaaaaaaaaagaagaaatccaaagatgtttgaatttcttcactaaatattagccagaacctgatatgtaccacagtgatggagtgtggttggtacttaaaggaaaaagaactcaggaagaatccaggaagggggcagtcaccttatgatgatgaatgggttttgccaaacctctcagaatttgggcttttgttttctgaccattgtctcactgagttctctgatgaaagtcaaagctcgtaaaattacagtgtaggtgttaatctagcacagcagttctcaaagtgtggctgggggctggtagggattctcaaggtcttttctaggagcacccacaggatcaaaactgccttttttttttttttccaagacaggatctcactctgtcacccaggctagagtgcagtgacactatcttggctcactgcaacctctgtgccccaggctcaggtgatcctcccacctcagccacccgagtaactgtgactataggcacatgccatgatgcccagctaatttttctatttttaatagagatgtggttttgccatgttgcccaggctggtcttgaactccagggctcaagcaatccaccttccttggcctcccaaagtgctgggattacaggcgtgagccactgtgcctggccaaaactgttttcatgtaatattattttgaaattatttttattttttcgaggcagggtcttactatgttgcccaggctggtctcaaactcctggcttcaagccatcctccttccttagcctcccaaagtgctgggattataggcatcagccactgttcccagcctgttttcatggtaatattgaagtgacatttgcccttttcactcttattctctcacaaatgtatggtgaggttttccagggacatcattgtgtgtagtgacttcatcactctgacaactaatggaatgtgtgcttgcatattctgtgttttaaagatttctcagattataattcctaatttggtaaatatcaatagatataaccaaatcagaagttcttggggttcttaatcatttttgagaatgtgaaggaggtctgtaatctgagttcattgagctggcattatggccccactgtaaagatcatctcagagagcttagctgggttagagaaacccttctataaaatcagtggaaatgaacagaaactagaggacaatacagggagtaaaggtgaactattctgttctgcagtactggggccaaaagaatgttggttctgaagtgttagtaatttgagtaaaaccaatgggttgcagttttccacatttaataacaaacaaccagacagtgaatttgaagaacctcagcgaagaagatctgaatatctttgctgcttgcattgggatataaccttcaaccttgacgtagaacagggcttacctggatgggtctttacttgagacaggaacttgggtaaagctacagagttttttataagccatgtagatattgtggggatgaggggccttatccttccgcatgccatcctcattggggttttgatcacagatctgtatttcctgggatacctgagtgccctcggctttaacccaagttcagcttagcactcctgagtggtgagattctcaacttaagagggacggttgggccggaatccttgggtctgatttgctgtgggaaggggaggaggctaactgtcccatggacctggtcacagctgttccacatcataggtcttggcctcaccaggccttctctggtcagtgaaacaagtaggtatttgtcatgtacctgagcacggggcatactgactattgcttattgccatggcatccctggaagcacgctgcaactatttgggactgacggtatcgtaccttccctggtcctcttatcacattgtttccaaacgggggcaattttcaccccaggggatacttggcaatgtctggaaacatttttggtcttcaaaaatgtcagggttggggggtgggagtgggggtgcttactggtatctagtggagttccccttcctccttcattcctttctctgccccattgcctgccatgaacaacaggttcctggtagcctttgtgctatggttctgttgggaattggtgctctggcacattcctctctccatctgaggagtgtgaagagcctagatcttaaagctgaacagctgaggtgcaagtgatcgttctgttcagtaacagctgggttactttgggctgtttaacctctctgcctccgtttctccataccgcctctgtaaagtgaattctgataattaaaaaaagaataaagtggctgggtacagtggctcacacctataatcccagcactttgggaggcgagaggataacttgaagtcaggagttccagaccagcctgggcaacaagcgagaactcatttcaacaaaaaaacaaaaaaatagctgggcatggtggcacacactgtagtctcagctactcagaaggttaacatgggaggatcatttgagcccaggagttcaaggctgtagtgagctataatcacacaactgagagtgagaccctggctctttaaaaaaaaaaaaaaaaaaaaaaaagtatgacccaggcacggtggctcacgcctgtaatcctagcactttgggaggctgaggcgagcggatcacctgaggtcaggagtccgagacagcctggccaacatggtgaaatctcgtctctagtaaaaatacataaattagccgggcatggtggcgggcacctgtaatcccagctactcgggaggctgaggcaggagaatcgctggaatcagagaggcaaaggttgcagtgagccaagatcgcaccactgcattccagcctgggcgacagagcgagactccgtcaaaaaaaaaaaagtatgtaaagttcttggaatatgtgaatactcaacaaatatcactatcaatttctaaacatactgctaccaagcagatggaagtcccttttctaaggtgagcaagatgggtttcttgttgaggaggaagtttggaaagctcttcatatttattttaaggagcacttgggtagctatctcctacatttgattaaaaccggatgcaagcaagaaacttagtaaaggaaatcagatcagaaagaaaagattggcatgatgtaagtggaaaaactcagggaatacaagttttcttctaaggtcatatgtatgatttgaaagtcacaaaattttaatttgatgcttttcatctacaccacctaaatcttccatgaacctcttggttaaaaggctatattaagcacaatacttttaaaaaactagatcagagacatttttagctataaaaggctaactgaaaccattatttgagatccactgggaggcttaagagagttttgaagatagagtgagttaacagaacaaataatgtgtctgtcaagccaaggagcacaggcggctggccacctcccaggactgggggaagcctagctctagacactcctccctgccactgtccccatccattgaaccaggctcttgatgcaacaagggtcacaaatgaggctaaatcagagaactagagatggtatgactggccagctgaaaagcccatcaaaaatagctactgaagccgggtgcggtggctcatgcctgtaatcccaacactttgagaggcagaggtgggcggatcacttgaggtcaggagtttgaaaccagcctggccaacatggtgaaacctcatctctaataaaaatacaaaaaaaaaaaaaaaaaaaaattagccaggcatggtggtgggtgcctgtaatcccagctactcagaaggctgaggcaggagaattgcttgaacctgggaggtgggggttgcagtgagccaagatggtgccactgcacttcagcctgggcgacagaacaagactctgtctccaaaaaaaaagctattgaaaaaaaattagctgggcatggttagctacttgggaggctgaggtgggaggatcacttgaggctgcaatgagctatgattgtgccactgtactctagtctgggtgatagagcgagacccctgactctcaaagaaagctactgaacttgtctacctttgagaggccattttgaaggatagaggaagtaccagtatcgggtcagttggccagaatctctcattcctggagacaagcccaaaagtcccatctgctttttgttctcaaatagagaggcctcatatacatctggccatgcacatacgttatgccagccacaacagtgggcagtcactcgagtgcgttgcaggttgctggggctaccatgacagtgactgcacatgattggttttctgtctacgaagctcccagaaaacctggacatttctggagttccccctccctttcagtgtacttgtatagcacctgtgcaggagagcaccacacccctaacctcggtgacataaattctcactgaatgtagagacagaaggaaaggggacggcagagaaagcttgtctgtgagccttggtcacaagacctcagactgcagagacatgcaattacttttcttctgtcctttgtgtttccaaaagcaccatattttatttgataaaaggtacaggggaccattctgcttttgtgatgttgttttccaaatcaagcatcaggctctctggtctgagtaatgctttttgtgctgagtattaagtttgagacagtctaaacaattcctttgggggtactgaaatactttaaattttgcatcatttttgctagttataaaaataataaaagagtttcaacacattccatttgttctaagcactgttggattaaataaaattctggtcagcctgaagaacgtgggctatttcttgtgctatatataaaggtatgtggtctttactatttcacattaacctgttgctagaggttttcacaaatgtatcaattcacaaaagaacctcagagaaaagaatgtgaaatatgctaggaatttttgttaaccttggcttgatttttagaagttaaattttaaaatgttttagctttagaaggttcttttttcatttcttagtaaacatagtcattttcttggtgttttctaattttttaagttttaattgatgaaatcttaacatcttttagaacctaactgtaaaggtgtagttacaatttacaatttatagcatcaacttaatcttactatttcagttactgtattattccatttgcattactctaaggaatacctgagactgggaaatttataaagaaagaggttgaattgacttatggttctgcaaggtgtacaggaagtgtgttgccagcatctggttctagtgagggcctcaggaagcttacaatcaccacagaaggcaaagggggagctggtgtatcacacggcgagagtgggaatgagatgggggtgggatgcttctaggctggggtgcagtgatgcaaccatggcttactgcagcttcaacctcccgggatcaggcgatcctcccacctcagcctcctgagtagctgggactataggcacgcccaccacacccagctcatttttagattattttttgtagagagaaggtcttgttctgttgcccaggttggtcaccaactcctggcctcatgatcctcctgccttggcctcccaaagctttgcctttttttttttttttttttttttttttgagatggagtctcagtctgttgcccaggctggagtgcagtggcgcgatttcagctcactgcaagctccgcctcctgggttcacaccattctcctgcctcagcctcccgagtagctgggactacagatgcctgccaccacacccggctaatttttttgtatttttagtagagacagggtttcaccatgttaaccaggatggagctttacctatttttttaattggcgaatttttccttttattattgagtttattgagttatgagagttctttactctagacataagtcccttattagatacattatttgtaagtattttctcccattctgtgggatatcttttcactttcttgatgataacctttgcaacccaagattttttaaactttttttttttttttttgagatggagtctcgctctgttgcccaggctggagtgcagtggcatgatcttggctcactgcaacctccacctcctgtgttcaagcgattctcctgcctcagccttccgagtagctgggattataggcacacgccatcacgcccagctaatttttttatttttcagtagaggcggggtttcgccttgttggccaggctggtctcgaactcctgacctcaagtgatctgcccaccttggcctcccaaagtgctgggattacagtgagccaccgcgcccagccaaaagtttttaatcttgatgaagtctggtttatctatttttttctttggttgcttgtgctttttgtgtcatatctaagaaaccattggaaggcacattctgtcactgagatttgccagttgtccttactgtagtattttacatgggtcatatatttaaggtccttctgagattcctaaaaataattaattcccttttctcttcaaaagcttttaagttaatagagggtctagaagtgttcctctctcttcatcacttgtccttatcctgacctgccttaaagcatgatcccttgattttatctgggacatctgagccacaaaagtctctatatatatccattggcaagaggatggtagatccttatgtatgtcgatggtcaggattccttcaatttcagctcaatagcagagtggctggttaaaaatgtggaaagatgggagagccactgccaaatctcctcccatttttagctaatgatggttctggaagggactggcctgctatttcttacaattccagaaagtatccatgaatgtacatgctgctgctgaccagccttagggagggcctgatttcttatgggcttaaagttatagtccatcaaatctaagttagggcagataaaagacagcttatcaaaataaaggtacaagaggtgccattttgaaacctaatgctgtagaaaggatgtaggcaagtaacagctgtcagtaagcttcccacccctgctgcgctttcggtgtgtttgaaaagagaacaactccaagttccattttagaatgttaaagatctaaaaaatgtttccaaattaatttttctctcaaaggtttgctgatgcgcaccagactgtaaataattgccctaactgatggccaggcccttattctcagaaggggatataggtgtctttgtgggatgggtatccttaagcaggatctgtgctcctaagaacagcagcaacaggcagtgcagggaccttctgttgaattctacctgtaaaccacagcctgtctggaaggtctgactccaggccactcagccttggcaagcatgtacttccgaaagcgcctggcagaaatgggagctgatagacaggcgcacatggcagggggagatccttgtgcagtggcttgacactaactagaccagagaccatttcccatgttctttttcataacaccagaagcaccaaggaaagagaagaaaaaaattttgcacttatttttgggtcttttctatcacatgaaattcatctgaaacagttcaaattttgtttgatgttttagcaccccatttttcctgttataagatattcagtctctctgcagatataatgcaattggcttttatatcatgattatgtttttaaaaataaaataaatggagttgactaccacacagaagttttacttgggatggaaattgactcttcactaaaggtcaaaatagaatccatttgttttggctgggcgcagtggctcatgtctgtaatcccagcactttgggaggccaaggtgggcggatcacgagggcaggagatagagaccatcctggttaacacgatgaaactccatctctacttaaaaaaatacaaaaaaattagccaggcgtggtggcgggcgcctgtagtcccagctactcaggaggcaggagaatggcttgaacccgggaggtggagcttgcagtgagccgagatcgcgccactgcactccagtctgggtgacagagcaagactccgactcaaaaaaaaaaaaaaagaatccatttgatgtgcacgcatctcttaagaagtgactgaaggctcgtgcctgtaatcccaacactttgggaagtcaaggcaggaggattgcttgagctcaagagttggagaccagcctcggcaacatagtgagaccctgtctctacaaaacattaaaaaattagccagatgtggtggtgcatgcctgtggtcccagctactcgggaggctggagcgggaggcttgagcctgggaggtggaggctacagtgggtggtgatcctgctactccaacctgggtgacagagcaagaccctgtctcaaaaaaaaagaagtgactgaattacataaagctggatctcttaccagccccctgcataccccaatccctctgtctttgcttaggttgggctttcttttatgaataatagaaaataagaaaattgcctgttttgggcaatccaggtgtgtttcagagatttggagttaaaaagtcaagtaaatattttggcaacccaacaaaggtaagaaaagaagcatgcacctaacgggcttctcgaattacaggcttgtccaaacactgccttcctcaagagacgctggtcagggacaaagcctgccctgctgtcaacagcaaggcccggctgagaagtgggcttgcttctcttgctggtcctggccctgagccagataggacgccatttgactttgattcagtctgacccaagagaaaatataccatcagcaagtggaggatctttcctccttaacagactttagtcatattgcttcttcttccttgctgaaaaaaagcccaggtagatttttctctcccgttaaattggaaccctgaagttaggaggcacagtatctcagatactgtcagataacaagagccaccttttcagtctctgtaacttcatctatctcgagggttgggaggcagacagctatgaaagaagacccaaaagcagcagaatctgggcatcccaagtgtacccgaagcacgccagtctaggtggcccctctgtcacctggtttaagaacagacatcttagaaggaaggagctctgaccagctagtggcatgtctcctttcaagctgtgctttgtgtctcttcaacagaaaggcagacatcagagaactgcctctcttcctcgccctcccccagtggcttcccctggatcaccttggcagggcctcatcctgaggagggtgggtggaggagggaggagggcgggtggcggctgcagtggcggctcctttgatcacctcccgcccggttccagtccctgctgccagcaggccagccaaaggcccgactctactgatctgatgaggtgctgaataggacccgaagggcagggacagagcaagaagaaagcttcgggaatgaaaaggaaaccccgtgaacctgctcggcttcattggccggattttcctaccagggagccgctcagttcctgccagccagggactgcctgcccctcactctggcccctcttgtctccgcttttcagacctttgtgtgtgttttgtgtttgaatcacggctgctctccctggttctcaggctgggaacccactgcgcctgtttccatggtcactgggaagctcttagcgccatgtgcttcaaagggaacctttcccctcccagcactcgctgctgcctgccccagccaggctcacaataagcggctcctccaagccaggcctctgaccctcacttgccaggaggaaaaccttgcctttgccaagcaaggctgtgcagcctcacagaaatattcctcagcagagcatgtggatgcacacacacttgtggcacatcagtcctcacgtgcctacttgtagatttttatgagatatagagcttatagattggtgagagagtgttaactttcctcacatccctctgtttaggaacctttctgaaattgaagaaaagagcaaagcctaagccccttgtaggaaaagagatgagcttgtttggggtaggaggaaaggaggaagaagacccatgtcttttgggtcagcagagaatggaattgaagaacttagctctgggcttcctctccctgcagctggggtggtgagggtggtacctgttcactcttccagggccaaggatgcctgagcagttgcccaccaggcttgaaatttggctttgcttatttgttgaataatgcaggggaatgaagcctctcacatctgactggagagagtcagtggtctagtgatcttggagggctgctacatgatgacactggaattaaaaggtgactgtcaggccaggcgaggtgggcggatcacctgaggtcgggagttcaagaccagcctgaccaacatggagaaaccccgtctctactaacaatacaaaattagctgggcgtggtggtgcatgcctataatctcagctatcgggaggctgaggcaggagaatcgcttgaaccctggaggcagaggttgcagtgagctgagattgcgccattgcactccagcctgggcaacaagagtgaaactctgtctcaaaaaaaaaaaaagactgtcctctgaagagcttatgttttagatgcaaagcctgctcccctagcttggagctcacaatattaatatctgccttgggcttattgcactatatagagcctgtatgggaaattggacatttctccagtattaccagtgatcaaggttcttatcatccgtttctttttttttttttttttttgagacagttttgttcttcttgtccaggctaccgtgcaatggcacaatctcggctcaccgcaacctccacctcccgggttaaagcgattctcctgcctcagcctcctgagtagctggacttacaggcgtgtaccgccacgcctggctacttttgtatttttagtagagatggggtttcaccatttggtcaggctggtctcgaactcctgacctcaggtgatctgcctgcctcgtcctccgaaagtgctgggattacaggtgtgagccaccgcacctggcccagttgggctcttttgactcctgatattgtctttccttatcgttcctggttccttatcagtctccaggctggctgctgttggagtgtgggtggccccctgcagaagacactctcagtagttgtgctccatggctttctgtgtagtgatgggaatttcagggccatttcagatgtgccctttgtattactagaataaagtgcacctatttggtattaactctaatttctacttgtaactcatgattctggaaaaggtttctaaaacttgcagacttgaagcttccatcattgtaccaaaatctgtcttctctggccacatgtagcattttaagggtaggttttgataaagtcttagcccaggagccgcagcatcccaaagatgcttttctgttagaacatgcatacacagacctaaaagttagtacatttggcatgcctgtgaaaagcaaactgaagaagaatgctggctaccataaaacaggtgtcatgattgcattcctactgtatgccaggtgttttcacacattatctgaaatccttacagtatccccggagagaattgttatcagatgatcattttgctgctaatgcagggaggaggggacagaacgacttgaataacgtgtgtggtcatgcagctggtctgggcagaggtgggtgggagcaaaggcccctggctctaatgaatggtcttcacaggggtacctaccagtggttttgggattactttgaacagattctagggggaaagtttggttaaatttaggtaactggtttctcatcatttgggtacttgggaacctaataagtggacaaaacgtcccactgaaattatcttgttcacgtcatgcacggtggctcatacctgtaatcccagcactttgggaagccaaggcaggggaatcgcttaaggccaggagttcaagaccagcctgggaaacatggcgagacccccatctctacaaatttttttttttttaaactagctgggcctggtggcacccacttatagtgcagctactcaggaggctgagacaagaggatcgtttgaggctgcagtgagctgagctgtgatcgcaccattgcactccagcctggggtgacaagacctcatctctagaaaacaaatctctcctatagcttttaatttgctcctgatcgttcccttttgtaatatttttatcatagctcccctttttcttttatcagtttgcccctttcatagaaattccatttcttccttttttttttttttttttttttgagacagagtttcactctgttgcccaggctggagtgcaatggtgcgatctcggctcaccacaacctccgcctcccaggttcaagcaattctcctgcctcagcctcccaagtagctaggattacaggcgtgcacaaccatgcctggctaattttgtatttttagtagagatggggtttctccatgttggtcaggctggtctcgaactcccaatctcaggtgatccacccacctcggcctcccaaagtgctgggattacaggcatgagccacggcgcccggctcagaaattctatttctttcctttttgcaaagttacctgaaattgtacctctctcatttgtatgctcaatgaggaaggaaataagagagggtggcacaattaatctgtgttcaaaaatgtcatcatcactgtgtctcgtttgataagcagattgtattcttactagtgagagtagaagatcctgaatagttcagagtctggccagggcaccacaaccacacatttcagagcactgggccatggctgtggattcccccgaggaacgagtttgctgatgaccctgtttgtgctctccctgagggtgatggtttcacttattccatgctctgagccaactctcctaagattcttttatctaacatggcctgcagaagttaatggtggcatgatttactttgactattttagatgccaggcgtgtgtcttgaagagaccagtgaagaggggcttgaagttctgattcactcgaacttttttgggttttatgtctttcctttctcgtcagcatcaaggccatctaacttcaaggctgaatgaatgagttctgttttccttaatagggagagggaggagatggcctaggactcattcacagctgtgtgtgtggaaagtgcattggtgatagatcttgacttatttagtgatttttcagaagattgttggtttttcactggtaagaccaacaactatccttgttaaccagctttaaccagaaggactaaggaagttggacatctcgtaccactcgcaattgattttctaatgcagttctcttgtttaaattctgtggctgtgataatctaggtagccaattactcttttttgttaactaagaagatttatactgctgttgtgctagggtttgtaatttaaggtgtggacatgtccaggatgttaaatttagcttgtgtctcaaaactagagctatccaaactcttttttgctctggttgccctggtcccttgatgttcagcaagcagctttgcagtgcccacagcactccggcctccctccttggtactgcagggccactgtgaagagggaatcaggacaggatccttcaggtcttggcttaggcatctttttttcctaaaagtctttctggaccaatagtctgtcagcagggacggcttcacagaagagatgaaactcaacttttaagactggctgggtttgggggagggaagagaccaagaaggaaattccagcagtggggctggcaggagcagaaataacatgtggcgtatcccagagccagtcaaaaagagcaacttgactgggcgtgatggttttagcaggcaggagaaggtccccttgataaggaaggcatttccagggagtgcatcaagaggcatgcagaataatctgtcataagagtagagtttaaaaaaataaattcaaaaaaagaggcatgcagaagagtagtgcgcggtggagggagggaacaggatgtgcttaggcctagaaatagattgccattctggtcatttccatgatattgctgtgtattactgttctgtggcaatttaagtaaaagagaggaataaaactttgtaatgtattagagaccttaaaacttaaaatccaagaagatttttatatacctgaattaaaaagtgggacttggtagaagttacccaggaaacataaaaaaatgaacagccttctcatttccccacttctgtggtcctaattctttgaccttgaatcttctctctctctttaaaatggtggtaactatatacatcatataagcttcaccattaagtgtacgagttcagtggcattaattaagcacattcactctgctgtgcacccatcatcactgaccatctccagaactttttcctctttttttttttttttttttgagacagtgtctcgctctgtttcccaggctggagtccagtggctcaatctcggctcactgcaagctccgcctcctgggttcatgccattctcctgcctcagcctcccgagtagctgggactacaggcatctgccaccacgcctggctaatttttttttgtatttttagtagagatggggtttcaccgtgtctgccaggatggtctcgatctcctgacctcgtgatccacccgcctcggccgcccaaagtgctgggattacagacatgagccaccgcacccagcccctcttcttaaactgaaactccatacctattaaacccaggctcctcacttctgcctccccacagcccctggcaaccaccattccactttctgtctctaggaatttgaccactccaggtcttttgtgagtggagtcgtgtatttgtccttttgtgactggcttctttcacgtggcataatgccttcaaggttcgctcttgttgtagcatgtatcagaattttattcctttttatgatggaattatatatatcccattgtatctacataccacgttttggttattcattcatctatctatggacacttaggttgtttccaccttttgattactgtaaataatgctaccatatatattctgtatattgatcccttacctgatatacatgaaatagtctttctcatcctgtggcttgccttttcatcctattgatagtatcctttgatacacaaaagttttttctcatttttgtttgtttgtttgagacagagtctcactctgcacccaggctggagtgcaatgctaccatctcaactcactgcaacctccgcctcccaggttcaagcagttcttgtgcttcaacctcccaagtagctgggattacaggtgtccaccaccatgcccaactaatttttctatttttagtagagatgggtttcatcctgttggccaggctgatctccaactgctgacctcaagtgatccacccgcctcagcctcccagagtgctgggattacaggcatgagccaccatgcctggccaaaagttttgactcttaatgaagcccactttatccattttttctttcgtcacctgtgctttcggtgtctcttctctttttttgtgcttgctctttaattcatcttcatctaccttttttttgttttaaacacatagaaggttacacaaacatatcttcctactcagccttggtttataatttactgttgccctaagaatttcagaaaggaaaagaattcttgcttccctggctaggctcttggggtcttgatgtgcaagaagaaatgctgttgtgaatacaaagaatgatgaggaagtatacaaaaggtgccctaggctggctgcgggggtccagcaggctggctacattattctgtggtcaacctcttacaaatggggtgctcctgtccgtctccgtggccagctgccaccagccctatggtgtgaatggcaaggaagtggggactggcggctggccgaactccaggatgcagccttggctggcagagaaccaaaggcagagggggaaaaacactcttgagtatgagagaaataatgctagctccgaaacctataattcgcaagtttaaaaaaatttaaaaaataaaaaagatttttcaaccaaactgtgcttttatctttaggttctgaatgggagattgttcacacagctaagctggctgcagaagctaggccagttaaaacaatatgcaggcagctctcctctaagtaaccagaaactgttggctcaaaggagcctgaaccgaggaaccaacctgctgggagacgttttccaagtaactccaagcaacagcctgaatgtaaatcctcccgctggggaatggcactttggcaaatgaagaccctaattagagatggaagggtttctattttgtttttctttaatccttaccctggggcctttgcagggccaccatgtctctgcttgtgtgcaaagaaatttccagcttctctttgtaacaagatcctcttttgggaaagaagcaacaagccgacaatgtgggcccaccacagccgggggaccctgcaaccagcctaatccaaaacaaaaaggcctggtctgggccggagcagctgggtcacctggattggccaagtcgtttgaagttgctagccaagttggatcttatgttgcccctgccccgtgagacactcaaatccgtgcttagagtgcaagtgaagtttcttaacttccaaaggagaacagcagtgtgaacaaaatgcaaagcagtaagagagaactgtagctctgaggcactagggccaaggtccaattgaatgggtgtggagccctcttatctcctcagccttctatttgggtcttcactattggatctaaacagtgaagcagagggactatgctctctttcaaattgatcaccttagttctcaaaacatccagaagtatcacatacgtggagaacctgcccacgccagtgttgttttgttgtgggtgcaccattgacttacccagtattctcaaggtcttcgaactgatgattctgctcaatttcatttctctttggccctggaaaggcagttgagtagagctctctgggaccaaagtatcaagctggtcagtgaatgatacaatcaattttagatagttgtggataactgaagtgaaaacaaagacatacctttcagcatcctttacactggtaggtgtaggaagggcccccatcgagggccgttaacttacttgttaaattcgcagcttactacaggatgcttgtgtctaagtgatttcaacttctgaaggggaattacacattttttagtcttaacataggaaggatgcttctccctaaccacgactccatgctgagtctcaggctgggctctgtccagatagaatcatctttaatatttacaactctgtgatctggttggtaccctgctttaaagatgaatacattgagactcaggggaaggggctaagctacagacatcagccatggctccgtcccaggttagctccagacctcctgctcttctcatcagttctgtcctttgagttacttaagcgtatagatggtagttgatacagttctgcataacagactgataggttcctgaccaacagtctgctcctaccccctcttttttgggaagccgagtgctgttgaagagccacccattcctggttgccacatggtagacaaatatgtctgctgcatttacttcccagaagtcctcagcttgctcatgctgtctaaagttagctttcagggaatcccaagatgtttctttttcagctctctgcttgtggtcaggctgcttcaacttggagaaaaacggcccattctgttagctgtcgggcaaaatgatgactgtgaagagtatcccttccatgctagtaacttcccctgttccaacttctcagtttaattttcagtgaagcttctagaaaccacttaaagtcattgggaaacaggtacatcaaggactaaaaagaaaactggttttgtagatgcaacattgatccctctaaaaagataaggcaagacgacaccttgcccttttgtctttgattttattccttggctccttggaacatgtgctgattaaatggcaaaatatgatggcaatttttaccctttgttattattgaaaatctttgccaagttacagttacagctaatttaaagctgtatccaaccaaaatggtgttaagagagggtccctgataatttggatgtcaacttgcacttgtacctaatgaacagcttgactcattcctggctaaatttatgacagtggctttggaaggggactcagatatcaagaaccagattctatcacagatttttagattacttgtataggccataaaagcgtgatgatatggagtaaattgaataatactggatttttggcattgctgcttcattagcatgaggcactggatggggcaggcgtggaggcctggttaggctgggcgcaatgctctaacataagcaaccatgggcctcacagaatattggtggtagcctttcccaggatggtcttgcattgctaataatgctaaaaatgtctgtgttcagagaaaaacattatgaaagtcttaatagtctcaatattatcccctaaatagcttttccctggatttttttcatctgtcctggtcgtttctgtgtcattgctgtaaagtcacacagccaaagtcacacagccattccgagtattgcagtgacaacagcaaggatcccagccaaaatcttgtcctcaggaagagctgagacatgttactctaattatcactgatggttttattgctttggggtcatgtctcaccccttaccccctcacttagtggcatatttgatgttgttcagtcatctgaagtcactcatttatcccctgaatgtccccactggttcccccagtggcagcagtcccccggcctgcaggagttgtagtgcaggcttgggtgatgtgattcctgatgtaggtgagacccctgaaccaagagcagttcagcagctgcagctgctcagaagctaggcttacacaccatctccctgccgctccgtgtttgacagaaagcagagatgcttcagcctcctagctgcacttaaaggtagcctggatgcagtgagcttgactaagtatctcccttttgtagctcagtgtaaaatacagactctgtttttggaattcattcatatgtttattaagcactgcctgtatcccaggcagtgtgctagacgctgcagatacagtacttattaaagtagacaagttcactgcccccatggggctcctggtcagtagaggagacacagagacaactagcagcaagtaaacacaaagacaacaaacagggcaactgcagattgtgatgcagctgcaaggccaacaaactgggtgagtggggcttttctctgcataggctgcctcgagccaagagctcagagtcaaggttcctgaaagaagagagggaaagattcccacagcccactccccacatcagagcttgcctgcctccgctccgtcatctgttctttgacacatctgcaacctggggtgtgctctgatgcttcctgtcattctgtcactttctaacccatcaaacagcactttgctaccatataagtattagtatctgcctcctgtctgctaagaaataaaatgaaggcactcaagtcttacagaaagttagctcctttattttaggtatctcgttaaatattctctacttgattattatgtgacagttgcttttaaatcctctgaaagttgcataatatgctatgtgatacgaaaggatgtatatataaaacctttatttttctaataattgcctataacttaccagtttgaattgttttaacgcttattgtagcctaagaagtccaaagtttaattgaaatccagttttgttttttggctttgggttaatattcttccttccaggctgggcacggtggctcatgcctataatcccaacactttgggaggccaaggtgggcagatcacctgaggtcaggagttcaagaccagcctggccaacatggcgaaaccctgtctctactaaaaatacaaaaattacccaggcatggtggtgcacgcctgtagtcccagctactcaggaggctgaggtgggaggatcacttgaacctgggaggcagaggttccagtgagctgagactgcaccactgcactcccgcctgggtgacagagtgagattctgtttaaaaaaaaaaaaaaaaaaatccttccagacttctttccctctcccgtggttttaggaagggaaggacagctgggcatgatggcttaaccctgtaatcccagcagtttgggaggccgaggcgggtggatcacctgaggtctggagttcgagagcagcctgaccaacatggtgaaaccccgtctctactaaaatataaaattagctgggcgtggtggcacatgcctgtaatcccagctactcaggaggctgaggaaggagaatcgcttgaacccaggaggctgaggttgcggtgagccaagatcacgccattgcactccagcctgggcaacaagagtgaaactgtctcaaaaaaaaaaaaaaacaaaaaaactgaaactggcttggctgatgaaagttgtatcttatactgtgaactgaataatgttgcaagagattaagtgatcattactaaatgatgcccctggtactagtgaaggttgttgtcatagttcatgcagacctgcacagtgtatcgacctcatgttcacatgaagatctagatacctgatcaacgaagtgtccactcagcccctgtcaggtgcattctgggaggtgaagtggtatgtgactgccttgaaggaaggtgaaagcctagagacagattgtaatggtttagaactttctctttagaaaatagtgaataaggaaacaaggctttgctggggcagggggtgggagctctggcaaataagaggttcttctagaacccacttcctttgttctactaagtaaagtcttgctaacgctgaataattatagtcaagaaagcctgaatgaggccatccttttacttgttcaataaaggttaatttaaggacccaatgggacttgagatagagcttgaatttagggatttttgcaaattacctgttaaagccatgaaaacagaagtgtatttgttccttaatatgtgcatgacctcttactatttaagagtgattactgattaaccagggagtttcaaaggagatgttttcatattcagatttaaagaagttgctccagctcagagaactggcttctgttggagtgagctatgaacagagtagggctgctctatctcagagcattgttcattcacctggagaaacttccttcctgtgtcaagcacctgtagcatgctaggggttgtgcctgcccagtggtgcactaaagccacctctgcaatgttttcatccaagaaacatgaagtaggaaggaaaagtaacacttgcctagaaaggaaagttgtctgctccctatattctctatgaaattgagacagctattctttgcccccacaaatggcctttaggacagaaccattgagtgtcaaagacaggcccagcctctggagtatacttgtctatttccatttccaaaggtgagatgttttccaggcagagctctgtcagttttatgaaagccaaaaatgcattagccacacagggtacacttgtgcagtattttaagtgtaacttggttgccaacacttgaattggaaggtttaatataaaaatccacatttctaccttctcttgaaaaatcagaaggtctggcagtgctggtgtcccatttctcctggtaaaggaagccccagctgcctagaagttgcccccatcaggcaggtgtacactgtccagtctgccacggcgcctgccactctctgctgtcctcacactgcagcagcacatccattgccgtaaatcttaagtgtggcccctgtggacaattgagtttgcaatctgtgttgtgtgatttttaaattgcagggaggaagatcatccaggctgtctgtggaaagttgagcaaatcaagtgtgaacgcagaccaataatttctgacagtcaaaccataaatatgaagagggaccacagagaagctggattagcagacttgtatactctgattttgtcaagcactggaagaccaatttagggtgaccatatcatttgtcatccaagctgagacgcttttgagaatggaaggggttatggtgggaggagaaatgtaaactggggctgtcctgggcatgctaggacagaaactgtggacaccctaggcctgtgaatgggacatggaaacagaaagcttatatccgtcaaccaggatgagtgcagaaaagactcataagaggagctcacatagaggctacgctggtatagaaattgttctagaaaaattgggcaagattttgcagagaaaggaggcttttagatgtgtccttaagcattgaagcgctttgagaggtaatcaagggtccaggacagcagttgaggtaacatgaataacctatgcaacagctggaagatgtgcgtatgccttaacttttcagaaatgggggaactgtgtgggtggagcatctggtgcttggagggcagatagtgtgggaggggagggcggacgggcagaccggatccaaactggatccaaaggagagtcttgaacattataaggaattgagacttgaatctgagaaggatgagaagacagctcagggcatcatgtatggaatgaactggaaaaagattggagacagagaaactgctgcattacagggtagcagggatgcaaagggagagcccacttgaaaatgattctttatggagattggatgtggagagaggaaggggaaggggtagtgagagaagaggaggaagatttgggtttctagatttgtatgatggtgattcccttaacctgagacaagtaatgtaggtttgggagaaacttggtgactttgactttgatcaggactagagccctgactctgactttgaactggagccctttgaactctagccctgaaaagggtcagggctagagatgaaggttgagaagtcattagataggggagtgtgtattcaaaccaggagtccagaatgagcttgtccagaaaagagtatagactaggaagagagaaggggtacagcataggacttaaaggaaaacaagtaagtgagttgggaccatgtaagagtcagtgaagggaacccgaagacctcagagagaagaaaacagaaataggctgaggagcacaaagcaatgtaaacaggttggtagagtagcaatagtacagatgacaacacgggtgaggtagcatggccctgtgcattcatttagcacaggtgtatcagttagcttttgctgcataacaaactgcccttaaaacatagcaccctaaaaacaacagtcattttcattgctcatgattctgtgggttagctgagcagttgttctggtctgtgccagcttggctgatctctgtggtcagctagtggttcctctgggactgagtgatctaggatggcctcactcaagtgtttggggcctcacctgggatagccatgccctctcaacatgtggtctcttatcatccagtagactagcccaggcttcttacatgatagttctcagggttcccagccgcaagagagggcaagcatgaacacccatgaactattcgatcccctcaagcattttccaagcttctgctggcattgtatttgctcatgtcccattgaccaaagcaactcatgtggccaagcccaaattcaaggggtggaaaaataagctcaatttcttgatgggaggaatcataaaatattgtggccattttctttactctaagaggtgtgaatgtcttgtaacacttggcaggagatatttgattctttgtgtcaatcatgtatcttccttctagttgagctagtaaagattgaagattacaacagaacaacttaaattctgaagacccatttaattgtgattattttaattctgttcccatatgaaagctgaaggtagtacagggaaaaacagtaccacttgcattcatgacatgaagctaaagcgattactaaagaaattgataatacccagttcaaaactcaaacacaggtcccctctgtcaaagcagtactgtctgatttgcagcaattaacatcttagtgccatgttatttaagactagatcaatgattagcaatcattaattggcacctaccatgtacccaaactacaccaagcactttacacccatgaactatttaatcctctcaacaaccctataaagtacaatcactgtcttagttctacagatgaggaaactagggatcaaatattaagtgtcttgcccgaggatatcagtaagtgtgatagaaccagaaataggaaatagggatttccctcaggccactgggctcccctgactgtaggcagcattagcaagtatgcaccccaccccacccccatcttgattatccttatcttgatgaaatatagttgtcccctcacatttgtgggaaattggttgcaagacctcccccccaatccccccatggataccaaaagccacagatgctcaagtaccttatataaaatggcggtagtatttgcatataacctatgcacatcctcccgtatactttaaatcatctctgattactttatgatacctaatacaatgtaagtactatgtattaataaatagttgttataatgcatggttcagggaataaatgacaaggaaaaaaagtcatgttcagtacagacacaaccatccttttttttttttttttttttttttcccccaagacagagttttgctttgtcacccaggctggagtgcagtggcataatctcggctcactgcaacttctgcctcctgggttcaagcaattcttgtgcctcagcctcctgagtagctgggactacaggtgcatgccaccatgcccagctgattttttgtattttagtacagacgggctttcaccatgctgcccaggctggtcttaaactcctagactcaggcaatccatccgcctcggactcccaaagtggtaggattacaggtgtgagccaccgtgcctggccgcaaccatcctttttcttttccgagtatttttcatccgtggttggttgaatgcacggatgtgaaacccactgataaggagggccgactgtatactcacatctactgacctggggtctgcctgcctcccagagtccaggtgggctctgttctgctggtctaacttacccattcatccagatttcattgagaggggctttgtttttgtgtgtgtgtgggtgtgtgtgtgtgtgtgtgtgtgtgtgtgtgtgtgtttgagacagagtctcgctctgttgcccaggctggagtgcagtggggcgatcttggctcactgcaagctccacttcctgggtttacgccattctcctgcctcagcctcctgagtagctaggattacaggcacccaccaccacgcctggctgattttttgtatttttagtagagatggggtttcaccgtgttagccaggatggtctctatctcttgagcttgtgatccgcccacctcggccttccaaagtgctgggattacaggcgtgagccactgcactcggcctgttttaaaaatactgtaatcccggctactcagaaggctgagggaggagaatcacttgaacccaggaggcggaggttgcaatgagccaaggttgtgccatcgcactccagctggggaaacgagcgaaactctgtctcaaaaaaaataaataaataaataaataaaaataaaataaaatactgagccagttttagtagatagcagaaggaggtattatgttgctcgatctgcataatttttaaaactggctttggaattttcctatattaactaaaattaaatgcattcacatggtgaaaggttgtctgtgtcaaaatagttttgctttgaagtaataagaggcaataatggaaaaagaatagttgcagattctcccctcactccttgttttaatcttttttttttttttggagacagagtctcgttctgtcccccaggctggagtgcagtggcgagatctcggctcactgcaacctccgcctcccaggttctagagattcttctacctcagcctcccaagtagctgggattacaggcacgcgccaccatgcccggctaatttttgtatatttagtagaggcggggtttcaccatgttggctaggctggtctcgaactcctgacctcaaatgacccacccacctcgacctcccaaagtgctgggattacaggcgtaagccaccgtgcccggccttgttttaatctttattgaagtataatagacatgtgataaacagcacatatttaaagtgcacaatttgttaaggtttgacctatatgcacacacacatacacacacacacatgcacacacacacacccattaaaccatcaccacaatcaagatgaacatatatgtcactccccccacattccctcaattcccctttaaaatccctccctccctttcctggcttccctgccaaacaccagacaactactgatctgctttctcctactgtagacaagtttgcattttatagaatttaacacgaatggaatcatgcagtatatactgcttattctggcctctttgacgcagcataattattttgagatacattcatgtggattgtgtataacagtagttcatttctttttattactttttaagaaaagagaacgctgctttttttactctgaacttgggccaggatgattgaagttacctacgaattgtacattaaccaactaatggcagtgaagagttaatctgtaacttcatctgttagctgttaacgtgacccccaaacctaacctcctcttgactgtcagatcctgatcccagacacactttctctaaaggctaaaactgaagtaggactggagacttggggagcctggtatttctgagtcttggttggtccctgcccatcactggatcttggtgtagcatggtctcatgatagtgtgagaacagggttaggtatgtgactgtgtgaccagcagtactctgttaaaaaccttgactttaaattacttcatgaagtttcagatgggggaaaaagaacccacaaccctgacttttgtcagctgtccgtcttacaagtctgagttacgcagatgtcctaatccttttagaagcaatctcagtaggttggagaatttattgttgttacagatactcactttaaaatgtattaagtgaactcaattggtatatttgaaaatactttaatttacccttcttttcaagattccatctcccttataagctaccatacacttgcctgctagcaggtcctttatagtcaacttccctgtaacaaatgagagttttttgggtataaatgtatggggtacaagtataatttggttacatgggtatattgcatagtggaaaagtcagggcttttagtgtagccattacctgaattatgtatattgtacccattaagtaatttctcatcgtccacccccctcccacctccaacaaattggtttttaaaaaattctttccttaaatgcttggcttcaaatttcctggtacaggaattctgtaattctgataaaaaattgcttgaaataatacacaaaatgtctatgtgtttactaatagatcctgattaaagttattattgagaaactaacattggagtcctctaaattctgatttcccagaaaacaaaaaatcttcaatattataaaacttaatggactctacagaagtcggggcagggttgacaggaagcagttggctctgatggaacaccctcccccgctgccagcacactctgacctcaggaaagtcatgcctcctttgcaaatcttggacatgggactaggtgtgctttcatcccactccaggactgagggacacttgattcagatagaccatagtcaaggtccatgttgcctaagagaccctctttgtcccccagcatgaggactgcagtgactttcaagtggctcccaggagtggagaagcaggctgcttcccttgcatgggatccattaactcccaggcatggagaagcaggctcagttccctacggtgggctatattagctcccacaaatggagaagcaggctcagtctctccttgggtgtgctgcattgtctcccaggaatagagaagtaggatcagtcatttattccatgtggggctgtctggccagaactcttccctccaaagggagtggtttgtggtccctcttctggatttggctcatcagtctttccaaatgtcccagccacctggtaggtatgcagtttgatttgtttagcccccaaatgccagccagttccccatgcctgcctgatagctgggtgcctcttgagccaatgtcggcatattctacaattacctgcttatttgtgggggttacatagtgcttgtagttatagctctctccacttacccacaaaccagactgccaaactcctggatcataaaacaaagtgtaagcaccctggatcatgacccagctcttttcctgttcttcttttgagactttcctaacaggaaaggctctgggtaattgatagagattatccctgattcccttaatgtaacctttttactctttccttttcctgggattaagctgttcttttgcaagaagtccttttcttaatgacagtcattcacctgttattgaccaaaggaagcgatccggcccaactccacctttctgtggttcagtctctcgagtctctttcattataatgactttcaaaggcattaactgtttttttttttttgctttcaattttctgcactgttaaaggctgtcaaactatactttaatctgccttcctgaaacaataattgcccctgtatttgttggtgaatatgagtgttaatattgagtagatgttttaatatttgctgagggttcccaggcagcgtgcgttgctactgaggtctgctgttcacaagataacaagttgatataaagtggagacacataggctcagtcagcagtgcctttcttcttcttgcagtcctgtgatatttctcttcttcagggcacttacctctcactgtgcatgtagggtccctagtataactactagaacaccatgagaagaggcactagatcttttaggactaggttcttttggcatatgattgtaccttcatggtatatgctcaataagtatttgttaaattaatgaatattttgtctggaagcacattgccacaggactgggccttggtgtagggattagggaaccccttccagaaaaaataaaatttcaggtagtgacccaaaaatgtcagtaaaccatagtgactgcttggatgctgtgttccagaaactaaactgtgggcatgccagctgccaccaacagaaagggtaatcactaaatagttgttaagtttatacaatggccatgtgagtggataataatacccaaccatgcaaccctgtgctacttttttttttttttttttttttgaagacagaatctcgctctgtcgcccaggctggagtgcagtggtgccatcttcgctcactacaacctccacatcccaggttcaagcaattctcctgcctcagcctcctgaatagctgggattacaggtgcccaccaccacacctggctaatttttgtatttttagtagagacggggtttcaccatgttggccaggctgatctcgaactcctgacctcaagtgatccacccgcctcggcctcccaaagtgctgggattacagatgtgagccaccatacccagcctctatgccaccttttgctaacctctcccctatacttggtgtgtctgctgcctccaccagcacctttgatatccagctgctggctggccttctcttcctcttcattctggcagcttggcctccatgaagtctttcctgaccacaccagcctatggcacacatcacccccatccaggatgctccattgcagaagtgtattgagcatccttcaaaataatcccacccaattaaactcttaatccatttgtttcccttgttggtctagttccatttctctttctttcttttttttttttgagacggagtcttgctctgtcacccagcctggaatacaagcgcatgatctaggctcacggcagcctcctgagtacctgggattacaggtgcaggccaacatgcccggctaattttttgtatttttagtagagacggggtttcaccatattggccaggctggtctcaaactccggaccgcaggtgatctgcctgcctcagcctcccaaagtgctgggattataggcatgagccaccgcgtccagcctctagttccatttctttaacctagtggattgcaagcccctcactgctttccagcccgaaaggggcattgatgggattgtgaacacaggacagaaagtagtattaatgattattgttacaccccggatgcgtggtagggatgcttgggagcacctttattctccagctagcattagctgtcgggctgaggaaggctagcttgatgactctgccacttttctccttccccctccatcatcagcaccattgtgatgactatttattgagtaccaggactggaacgcatttgggagaaataaaagcatagatttgacacagccttcattctgttagcctatggaaaggtgattatagcacttgttacttgaattagacccgaaaatatagcacattttagggtctaattcaatataggacactctgcgtttaacttatgttttacagcctaactcatgactgctatggccaatatcccttctccacacccccagaccccatcactaaaattccttctagtggcagaaccgtcaccacttatcacagataagtggatattagttgggcagttgacatacaagttctgtgacttggttagctcagttcagagtatgtttgagggcttacttcaagaaagcatgtgtttcattttttaaaaataggtcttaaacctgaaaatggtgtccttgagattctcatcgttctctatttttatcctgttatcgcagaagacccatctggaacttgcattccattgctgtctcctactcaaggcagaggctcctatgcaagaccctgggactcctgtggcatggaggccaaaggcctggacccaaaagtcaggaggacttctgccacaaaccccaaaagcttgccccgtataaatggttgctcttgtgcccatggctgtgtccacccagcatttttgtgcctgctgggttccaggtgccatgccaagacctggtgaccagaggatgtctgtgatcattgttgtttggaggcttttgattgtgagggacccagacttctgctttgggggtatctttccccagacatcacaaaaagctcaattgtttattgcctcgaagacacattttctcttcaacaagcgctttccttaagtctgaggtagagtagcataagtgggtttcttgaaaaccagaaatgtagctgagaaagcagttgggccattctaggagggaaagaacaagggcttgatgagttaggttaagaagcacattcccagctcaccatctctccctctcttacctccttagcatcttggtctgtggttacgcatcttggctgcacctaagagttggcctgaggagctttcaaacctacaaaggctagatctacctccagcccggttcccattagtcaatctccaggaaggagtctacccctctattttttatttaattttatttatttatttatttatttttgagatgaagtctcactcttgtcccccaggctggagtgcaatggcgcgatcttggctcactgcaacctccgcctcccgggttcaagtgattctcctgcctcagcctcccgagtagttgggattacaggtgcctgccaccatgcccagctaatttttgtatttgtagtagagacggggtttcaccatgttggccaggctggtctcgaactcctgacctcaggttatctgcccgcctcggcctcttgaagtgctgggattacaggcgtgagccaccatgcctggccccctctattatttaataagctcccccaggcattccgacataccactgggctgacagccactgaccaccctctgccagactcatgctgtgtcatcatttcttggcctaaactgggacgtccctgcatgtatatgaagtgtaacatggtcatgtcaacttccagaagccttcaggagatagattcagtgtcatccccattgtgcagatgaaataaaacagaaaattcatcacatgctcacagtcacagagctgggaaggtgagctaggatttcagtccaagcagtgtgagatacccccttttcttcctgctcttccactatagcagtgctaaaaagagcctgggttggccagcctggctttggtagggtgtcatcaaactgactgcacccagataagaataacatggctgaggggggccatgtaactgcccttctctagagaaagggatttgattctgtagctgttataaatgattttggtttaaggtgaagagataatgaaattttcttaaactctactaatacaaaatcacgtaaaaggagtcaatatcatagggtacacaggggaccattttgaaacaacttagatccttaagaataaaggatgaaagttgtagtgtttgtgaacttgcattggctacaatggcaatgaatataacgcctttggatgaaatagtctttgactaaataggcctgagtttttaagcaggtaaccctgtacaaaagtaggaaaatgttccaccctgccacctctcagggagggccagatgtgatgcaatgagtgtgataggcagcaaggggagaaaaaaaatccctccttatgttgactacatgagctgcacgacatttgtaaagggaaatttcaagagaagggagaccaagtgggttaggataagagctatctggaatttccttgtgttaccaggaaatataatacttacataagctattaatggaatatttggaggttcagcattcacattgatatatgtgtacgtatctccattacacttgattttagaaccccctgggacaacatgagtatttctctggcctgggattatggagagaggcttaggtcaaatgtcagctctccactttgtggctgagtatccatgggcaagttacgtaacctttgagcctccagctgtaaaatggggatcaacaccacctcccttgcagagttgctctgcagattcagtatcatttgaaagcactcggtgccttgcctggaacattaataggtactttccttactttccctcttggagtctcagtaccactctatgaccaagcaggggggccgtgctttaaggcccctcttttaaaccttctggccacagggtgaggagtccaaggggaagcccctgtccaaaccattcccagcatccctaaactcccctaagatgaccttgtgttggtttctagcccttacagacctctcttctaggaccatcctcctggaggcacagtgcactggcagcatgcccctcttcccaaggatgtagacacagcttggcctcaaagcctagggtgttcacctgcctgtgtacaaccccctcaaagtgcagggtggaccaggggtcagctgtctccacactgacatgctctggcaaggagctccaaggagttggaaagctcacctggaacctatgtttcaagttcttatgaaggtacatatgtcaagatagaagagtaagatctattttatttactagtttgttagcccttgtcccctgtcccacgaatgttagaagcaagcaaaaatgctttcatccaaattaccttcctcttcataaaaataagaaaatcatgtaatcaaaataatcttctgccttctcaatgagtttaccacctgattcagcaattttctaacaccttcatttgcctcattgtaagtagtcccagtgcatgctggttagatggcctctgggtctacatcagtccaactgaatcaggagaggagctccagaaggtgcactggacagtcatgccagaggccgtgtgcaattttaggttagatcagtggttctctgccctatctgaattttaaaataactgcgaaacttctaaaaaatatattgctgctggggttttatctatatagatcaaatcatctctaggggtaggtcctgggctcgagtttttttgtttttgtttttgtgttttttaatctccccagttgcctcctccgtgagcgaaggttgagaagcatagctgcccctgtgaggaactcagccttcagagagagcctgcccgccgcctctcatcctccagagaggctgtagggtgtccagactttgcaggcactgttgttcctcgttaagcctgatgctgccacctaattaacacttgtttatattaattagttgccatatgcattgaaggggagtggtcctttttgaagtttctagttgctgactatataagatttggcctgaagtgggacttctggaaactcaaccaagataacgacttccaggttcttccaaaagcttatcttccaggcataggcaggtaatgaaacaacccaactgcggttttttccataacatctttcaccccacagtatcgatggagcaggagggtgtggacaggctttcctgggtttttggtgctccttgtcaggtgttaaaacaaagaggatcattgtgtttcttggaactggcctaaacgtctatgtttaagattaagatctagggaaatgcatttccgtttgacacccactagtttctgattgtgaaaagggtaccaacctgtgcaatggcgccgcgacccggccgcggactccagcctctaaagtcgggtacctttaattaggagaaattaagtggggctgctacatattttgagaataagtaacactatttaaacttaggcagccttaaccactaacttaaccgctgaattctcgctgctacatgtctcctaaatagatcagcataatcttaactaggacttaaaatgcatcatcttcgttccggaactcagaacctgcagccgacgggagcctttggaggcttaatgactttaattatggcgagaaatatcttctcccggtggggaggggcgcggccggtggcgaggagggcactttcccgggtcggagaaggccggatggcagcccgccccgaaagtcccggcccgctggattgggggttcgggggtggggggaacatagagaagcagggctggtggaggggaggagggaccctgcagggcggtacacgacgggtgggagtggggaggaggagggctcctggcgcggggaggagccgcgggaggggggatgttggccgcagggcctcggagttctgagctgtgtttgtggcttcagcgctttgatctcctgccagggaaacctggaaggtcaggccgggctgcagccaagccctggagcgaggagccggcgggtggagctggcagcactgcgccacccaccctcacctcccaaccccccaagcagtgaagcccgcctggccgccctggcctctcgcccccgctcctgccgctgcccctgcccctgcccctctttacctcctgtgtgttggtctcctgtaggccgtagattaaggggctccaagtcttgaaagtaagctagccaaatgccctgcaagtttggcttagtaaaatcatgtatgttgtatatactttaaaagaaaccagatatttttttaaagctgtgtgcgtccctttcctccaccctcctcatccccaccctagtacaaattacccaagaaccacaggtgattccccctgctggttcgtgagtgttagggtctagtttgcctctcctcttctaccaccaccaccacccccgttcctggcaccaggattttctcaccggttacccgtgtgctcttggtgtgtgacctcatttcctatggaatgaaaagtttctgtcggaaaacagggcccttggtgaggcaggccttgggagcccccttgcccagcgagaatgtcctgtgtcatgcagtgactcatgcttcagagaacagcagctgaccagaatgttcaagagcctggtgcctgggtggtcactactaagtgaagaactcgaggaggaggaaaggaaaaagtgaggagtaaggatttaaaatccacttagtggcctccagagggagggggataacaggactcaaagagcctgggctctctggcctggggtaggacccgccaagagggacctgtgggcgtcaggcgtggccagtccctaggaccggctgggtgctctccatcgtgttaaccgcccttttcccctccctgaccacaggagcaggcctggtggcggcaacagaaacagggctggttcctgccgccctgcatttcagcagtgacgtgttccaggctccggctttagatggctgtgtctctcaagccttcaagcctatgcttaagtctcttgttaccccaaattagggcaccattgagttggggattttgaagctgtggtagaatttgccaccagttcacccagagagccaaggcgccagagcttcgcaccaggtggggaaagcagccaaacctgcactttcctggggttgggccgctgtatggtgtggccatatttctccgcaggttgcaggatgaactccatcagtcttttaggctggaggaaaggcaaggccccctagtgataatgggaggaggctgtaaaaattcacatacagcctgttcttgtggacatggccaagggtagtcatctggccagctttcttttggtaaaggtactaagggaggctcccattcctgcagaatggatggaacaaacactgcaagtggttgggcttgttttcagagagctttgatatccagagatgagcacacgcaggggctggggcctgatacagatccacaacaaggccaagccacttttagtgcctggggtcaaggttggccggaggagacacgatgtctgcattcgaactgacaaccagtaaaaaggctgtcaggaaatgcaacagcagaagatggcaccagtaataagaaaccgaatcctgagaatcttaaagtgcgaagaatattatgttccaagaaaatttggtagagaacagacctttctaaaaagtcaaagggaggagataggtggcctagagtgagctgcaatcagtgctttcagtagcagggcccatggtgtttgatgctaacccctagggcaaaagctgatcttttaggttaatcaacaaacattttttggccatttaccctgtgccaggccttttgccgggttctgggaattcagcaggaaagaagtctgacacactggctgccctttagtgaaggaggcattttaagtaaacaatgacagtgtgatgtcataagtgccacagtggtggagcacagcataaggccactgggcaccgcagcctgagggaataatacctgaacagagagagaagcagtaaatgaaccctgtggcagggggtgggtaatgtgctcctcattgttggtctcctgttaccccacatgtggccaccattgagtttgggattttgaagagaactaaaagaagctcagtctaggccgggtgtggtggctcaggcctgtaatcccagcactttgggaggccaaggagggtggatcacctgaggccaggagttcaagaccagcctggccaacatggcgaaaccctgtctctactaaaagtagaaaaaattagccgggcatgatggtgcacacctgtaatcccaactactcgggaggctaaggcaggataatcgcttgaacccaggaggtggaggctgcagtgagctaagattgtgccactgcactccagcatgggcgacagagtgagactccatctcaaaaaaaaaaaaaaaaaaaaaaggctcaatatagttcaacttaggagtttgagtgttgtgttcagaaacaataagcaggaggaggtcacatcttaccctaagagcagcacagtcattggagaagggtggtgcaggtcagatccatgattgagaacggtccctctgctactgcatggagaccgtgttggggagggggcaggggcgtgcaaggtgggctgggctgaggagcccccagaagagaatgttgttgggacttgtgagaaatctggtgtcctggccagggtggcagcagtggggatgaaaaaacgatggatggatttggaagtcagaatcagcaaaatttggtaagccattgggcataggtgaaaaggcaaagggctgcagttttgactttgccccatgggtggaggaatgggggagatggggtacctccttgaggagggagcccaggtttgggggaagtaaggattgtatgaagagcaggcccatggcaagaccccttgcacctacatccacccgagcaagaaatgacccagaaatgtccgggacagtgtgctgtgctctgcgaatagctgcagaagtaacttggggacccaaaataaagcagaatgctaatgtcaagtcctgagaaccaagccctgggactctggtgccattttggattctccatgagcatggtttctgcccccttcggtcacactacttatatgtaagtctgtcagagaagaggcccaagtgaacactcacttggataagaaggggagagacctcagtgtcttcatgctgctgcttgctaagcaaggtctcttcacccaggacagcagcaagtgtgttatgacagacaattccagaaggtcctggattgtgtcttccttgggatgcctggcacccagttggccctcttcagtagttgtcagatggaactgtatactcgaatgtttccatactgataaccatctcatttaaattatgggtgccatttagtaattggtttccagatcaaaatgtaggtcttctgtcatatccttcagccttccacctgtgagttaaagtgatggggagtgggttaaggggatgatactcctctcaccttgacataccatgagccatggagcagagtcctcaagcgtgctccatggaagggagagtgttaacaggagttgctgcaaacaggctttgtgttcaaaaaagtttgggatgctgggtaaaataggagcctctagcatgttagtgatgtatatgtcagggatagctctggaatgtgcagcatttctcaaaggacaccgaccaggaaaatcattcccttagtagatgcactttgggaaaggctactatagagatatgaggcaagtgaagccatgttcttaatttcttacccatttgcccttggaactaaatgtacatgctcttccttattgactctcctggactcttcagagagggatctgccagcaccatgggcaggatgtgtgcttggtgaggacaggggtctgtgaccacgcttgctgccggctgctgtatgagtccccagggtctagaacacatagtaaccagttaataactaccgtggaacaactaaattaatacatggttaatgcaaatagaatttgactgtgaaccatgcccagggcagtctgctttgttagaccttttttttttttttttttttttaatagacacacggagtcttgctatattggccaggctggtctcaaactcctggcctcaagtgatccgcccacctcagcctcccaaagtgctgggattacaggcatgagccaacgcgctcagccatgttaggctttatggggcataccaatgtggtcggtaaggtctacctcctggctcctgggagtttctgttaatctccaagggtatgcctggcacccaagcgaggcctttatgtataggacatctataccctttgactcagcagaaccactcatggctattaaggacagatgcctccagaatatgagtacaaggatatgaatacagcactgtttataacagagaaaatatagaaatctgctacgtgcctcttagggagatggtcattaaaggagctctgaataaccatacaatggaatgatatgtgtagctggtaagaagaatgaatatttttccacatcaatgcatataaatattgttgagtaaattgttgagttaagggggaagtagagtacagaacagtgtatgtccaatatgtccagtctatttattttaaaattttttttctttttgagacggagtctcgctctgtcgcccaggctggagtgcagtggcgtgatcttggctcactgcaagctccgcctcctgggttcaagcaattctcctgcctcagcctcctgagtagctgggactacaggggcacgctgccacgcccagctaaatttttttttttattttattagaggtgggatttcaccgtgttaccgaggctgctctcgaactcctgaactaaggcaatccaccctccttggcctcccaaagtgctcggattacaggtgtgagccactgcgcccggccttaaacgatttttaacagctggggtctatgttgcccaggctggcctcaagctcctgggctcgagcgatcctccctcctcagcctcccaagtagctgggattataggtactaatccagcatattttaaactacattttggtgggcgtgtgtctgtaacacatgcattttattcttgccaatatgtgggttaaaaaaacaatggaggctataaaccacaccattatgttaaaatgctgggatatagggggtaacagatgagttattttttgctttcaatttctgagttattttaaattgttcatatcatgcacatattacccttataaatagcaaaaactctaaagatgatcgtattttcagggaaaatgtattacagaagtggtaaacaacaagagaaaccctaagatattagagctcagagagaggtatcttatctgtcctttggctaaggagaagcaccattagttttatggaaaaggttacacaggaactggaccttgaaggattagtaatgttagtattaatatgatcaactcattatatttgactctaaagtgtctttctgcatgtgaagtatcatcatctagagagttactctcaaactcacttctttctcccttccacccagctcatcaacagaccgcctaacccagaaattaaatctgttgacaaatttgcctgtattgtctgtgccagtctatctatcttgtcatttatgcagccaagtaagaattgggtgggtatataagaggagcattaaaatttgatgtggattttattgagattcttcataatctttatattctttggcacagggcctacctatgtcctctggaaactagaaatgaaaaccagtatttattcaatgtagtattaattataattttaaaaactggaacaacccaaatatcagaaatacatgtatagtgtgtaggaaaaaaaaatcacagccatttaaaatatttacaaagaatttttaataacttagaagcttatgataaagaaaaaaagccagaaggcaaaattgtattcagtagaggcaaaaaattctgtttggggctcccatatgtctgcaacttcctgtaagaggttgaagacatgtcttcatattagcgctaacagtccagcttccttggttagcttatggtcaggaatgtgggacaaatgagatttttagtcatcttttgggttatttcctattaagactgtattctgtcaaagttttcccgcaataaagggtaggcactagggataccacatccaagagcttgacagaggaacaggtaaacaggtgaaagtggaatccgtgccccagagactccagggaatagagatggcggtaggtccaagccccaaaccaagtctgggtataactacacacactggggagaatgccagatccattcctgagtggaattcctggtaagtggtgggctctaggcttcacgttttcccacccacaaagtggtgatgggacaattctcatcataattggtacatttgcactggaacattctagactcaatcttactagtaaaagcacttccttatgaaagaaaaccacataacattcacagtcagggagcactttctttttaccagtagtaacccgagtatggtaccaggcaagcttgctttcacttataataaacatttattgaataaccataggagtggtaagtgccaaccacaatagggccctgtcttctagaggctggaattttgtactttgcaaatgtattttaagggcgcaagtgtttgctcttttgctacttgtctcaatggccacagacattatctagtctcgagtccagcagccctgggaaggtaaataaaaggaccgtggcaatctttcattcagcactctgcactgggtttctggtcacctgctggctggtgccaacctgccctggcctgagcaaggatggaagtagcaaaggtgatgaaggatgtgaagatacccttgtgggtggggatgaggggaagggcacatagagggcagcaagacaaggcctttggctgcttctgggaggccttgccaaaacttcccacctgtgttctgcagtcacacccttctgttaatcttgcactccaggctgtgcacagtttagggataacggccctctccagctacagcccagtttaccagtgactttcatccaaccatatccaccaggctgcatctttcccatcctttctttgaaagggccccagcttcagagttttggacgttaagtatgtgacttaaagatcctaaagataggatttctggtggccacaagactgtgaactcctaattagggtctaggtttgttttgaaataatattctggtctacacttgagtaattaaaatggtgaatgatctgtgagagtgattggttcaaggaatatgcctcatcaatttttaaactgaaaataagggcagggggcaaagaatgaccaagtaatgttctgttgcttttttttttttttttaagacagggtctcgccctgtcgcccaggctggagtgcagtggcacaatcatggctcactacagcttcaacctcctgggctcaagcagtctacctcagcctcccgaggagctgggactacaggtgaatgccaccatgcctgcctagtttttaacttttttgtggagacagtcttgctatattgcccaggctagtcttgaactcctggcttcaagcagtcctcctgcctcaacctccgaaagtgctgagattacaggcatgagccactgcacctggcctgtatttttttaatttcctttcagaacagtataataaaagtgtctttttctaaatatgggttattcatggcctattttaaatcctaagctggcttctgacaggcaagttccctttaggatcttagcttggctcccctcctgtccagtcctggtgtgtgcaggaaatacaaactgattttaatagtagtttacattaaatattattttaaaagtagatcacctgtgcgaatgaagtatttttctcaaacaaggtatgtccttagatcctgtgcctttgcctggttgtattggaagtcaagctgtaaatggaatttaagcaccatatatatatatatagagagagagagagagacagattcaaacccctgggctcaagtgatactcccgcctcagcctcccaagtagctgggattacaggcccgtgcaactacaaccagctgccttattactgacctgccctcttcactgtaaaaaccaggaaacatatcaccatgtcctagattttgtgaaaaacgtcttttgtgtctctcaaatggatcatgcttcatccggaacctctgagtccttgagacctccacgttccgggcggagcagggaagcctgaactttaagaaggccacgtggctaaatggcttccctgaggcatgtctctcctgggaaggcattccctaccccagatcctgcagcctttcatcctgaggccattagactctccaggtgcacctgcatcaaagcgcacaggtaccgcgctcctgatctggacttatctgaattgtaccttccccgagggtgctgtttgatgtgcttgattgtggaatgaaagccaaataaaggaatgagaggggctgtttatttcctcatttttagtgcttttcctcagggcccttctatgtctggagaaggaatttatgaaaaagcctaggataccacctaagcggaaaacaccagcatctacttacaattatattaactctggcatccatgagctgttggcctctggcagaggagtctgtgtccctaaagagctctatggatagccagtatggtggctcatgcctgtgatctcagcactttgggaggccggaatgggaggatcacttgagcccaggagctcaagaccaacctgggcaacatagtgagacctcgtctctaccaaaaaaaaaaaaaaaaaaaaaaaaattagcctggcatggtagcaggcacctgcagtcccagctactcaggaggctgaggcaggaggatcattcgaggccaggagtttgaggctgcagtgagctatgattgcaccactccagcccaggtgacagagtgaaagcccatctctgatagatagaaagatagatagctctatggtggaggaaagtgatgccactctcgcctcacactttttcagctgtgtcatcagcatcctctcttcctggaggagggtgacagggccagtgtagttctgagttgctctgatagcctgctgcttctcatttgagtgaccaaggctgggaatttagaagggactctagtcataataacataggcggcctccctgcaccccctccccctttttttttttgaggcagagtctcactctgtcgcccaggctggagtgccgtggtgcgatctcggctcattacaacctccgcctcccaggctcaagtgattctcctgcctcagcctcccgagtaactgggagtacaagcacatgccaccacatccagctgattttttgcatttttagtagagataggctttcaccatgttggccagactggtctggaactcctgacctcaggtgatctacccgcctaagcctctcagaatgctgggattacaggcataagccaccatgcccagccatcccccaccgccttttttttttttaacagatggggaaactgaggctgaggctgaaagcaattgagtgacttgtccactgttggcagcatgccagtggcagaggcaggaatagctcccaggattcattcctgactcctagcctagcaatctggtgatgaaacagggtgtggtggacaatcggcagagactttcaatgcattgaatctccattcaaaaagaaagggtcccctgcaagacaaagacagattgtccagagtgccagaacttcttaaactgccaaggaacttgcagtatactgaagattttactgaagttgtttttggtactgtttggtgctaaatacaaggaattggtttgttgtaaaagctatagggtgagactgccctctagtgggccagtggagctattggtctagctgtgttctgggcaactttgctttctcacgccacatcaatgtagagcgattattcctacggaaaggaatttcaattttattctttctcaagcactgtggcccatagtaactctgttgatctctaagcactagccatcatttgcgcgtcttatagaaggctgggtttgccttctatacatacacacattagaagtgtcttacttccctaacaagattcaggctcctaaaagccaggacatgcatgtatgtatgtatgtatatattttgtggagacagggtcttgctctgtcactcaggctagaatgaagtggtgcaatcacaacccaacctctacctcttgggctcaatcaaacctcctacctcagcctcccgagtagctgagactacagttacgtcctgccacacccagctaatttttctgttattttttagataatggggtcttgctatgttacctagactggtctcgaactccagccatgctatatcttaagtcttgtttttccacagcttctgccttgctgtccccttagctggacatggaattagaaggttctttgggatggaaaggaatccttcccccacctcccccaaaaagaatcccgtcacttctcatttgttcctaaaacattctaatctcatccctctgatcagtagttccccaagtagttgaatcatctgaatcccccagaaagcatacacaactcagtttcctgggcctgactccagccctgctcaatcagtctctgtggtttgagccaggaaacctgctttacaaacttcccaagtggcttttgatgtgtagccaggtctggcagccaactgcttcaaaaccccatttacaattatttttcacagctcccaccaccgacagtgtctccagaggtcttcagcttgtgtcacttattaaaattaaccattttgagactcattcagaaatactcaatatattcttctaactgggtgacatgggaaggaaaaaggaaccgcatgagatggaccaaaggcacttgctttggttgccaatggctctgaaacaggaaatactgaaaccaatacctctgtactgactgggcaggttgttgatgtgtaggttgttttcagtatttgggctggataggaagacaaaagtttgttaagttatcaattatgtattttcccctattataagtcatctgacctcatgattaccatacaaggtaggtgaaattgtcctctttaaaaaaaagttttctaattgacagataataattgtacatattcgtggggtacatagcaatatttcaatacatacaaggtatagtgatcagatcagggtaattcgcatatccattatctcaaacatttatcacttctttgtgttgggaatgtccttctcctagctatttgaaactatatgttattgttaactctagtcatcagtccccttctttatagatgggaaaattgaggattaggaaagtgaagtaacatccctgaagtcacctaagttggtaactgtcagattctgcatttgattacaggcctgattgccaaggccaactttgaaaaggtaagaggaccagagggccaacctgctgtttttttaactctggcaggccaagcgagcagtacagcggggagctactgcagtcatctttgatgtgtctgaaaacccagaagctattgatcaggtaagctcctcaggccatgccaacactgcagcctccctgagaaaggcacttcctttagtgagcttggcttgtcccggtcatgtcaccctcatctcagagcatttgctcttgtcttctgaagttaggtgtccatgtttggacataattcccaaaggaggtatactgggcgaggttaagagccagggaattggggcacagggggcattttctctttttttcccccgagatggagtcttgctctgtcacccaggctggagtgcagtggcgcaatttcagctcactgcaatctccacctcccgggttcaagcgattctcctgcctcagcctcccaagtatctggaattataggcacgagccaccacgcctggctaatttttgtgtttttagtagagatggggtttcaccatgttggccaggctggtcttgaactcttgaccttgtgatccatctgcctcggcctcccaaagtgctgggattataggcgtgagccactgcaccgggttcagggggcattttctaagacctttctgggccttctgcttgcccagtccatcccaaaacaagcgtcattctcagccttgctcttctgggagctccaaggctgtaatgttggaagagctggaggattccagacaggtattcagtgttccttccctccagcctttctttctctctactgcttcttaaagtaagcgcaccttttaaccagagccctctcttcttccttagctgaaccagggctctgaagacccgctcaagaggccggtggtgtatgtgaagggtgcagatgccattaagctgatgaacatcgtcaacaagcagaaagtggctcgagcaaggatccagcaccgccctcctcgagtgagcctccgcaccatttggcacaggctcggggccttctctgctactacctgtccctttatttcccttgggctttcattcctatctctgtctgaaatgctggcataccccaggttcctgcaggcttagatcagctattggactcaaggccagggtgaaattttactcatgttcctttatagtgaatttgagaaatcctaccagaaatagatacttttgtgctaagatgtctctggcctcttccacctggcattccctcttggccatctctcatcctttcttttccatcccatctccctctgaaaggcaaactgaggaggattgaagggatggggcatccagcacctggcttcccgtggcttccttcttctatctggcttagacactagaaaaaaaggcttgtatttccttcttcctgtagagtagattaccttattgaaactccccaagttaatttgagtctggaaaagttagctttcaactgggattgagttcgacggctaaatgaatagcatctgcatctcttaagtatgtagaagagacactactggccactaactcttaaccagcctcttctgctcaaacctcaagctgaagaattccaggaaccttgggctggtgccctatattggtgttatttcctcctcacaaatattgggacattcacagtgtaggatgattctttcccatacacaacatagccggttacatgcagcttccactttgcaaagctctattcccattggccaaatggaggtcccagataaggtggctgtgaggttttaggaggcagtgaggaaaaggtaagaactaaaactagagggagtttgctgaactgacttgttggcttctttttaaagggaaaaaaaaaagcgctttggtaaatatgactcattgtagtggaagctgatatttgtggaagcagcatacaattttctgagttgttgtaaaccattaattatacggttagtaatcactgttccctcaaaacatgacactcactcttttgtcctataaatgtgattatttgtgttgatttggaagggcctttcttaccagttacagccaactttgcagtattccacaggctttaccaacagagttcccttggctcttggggggcctggctgagatcgccacaggcgtccccctgggccacaccaaaggcactacatgggcctagggagcacaccatgtgcatgtgagcagaaccccaggagtttcctgcaaattgaggggaaactcatcccggtcaccccatctttatcctgacaaagccaagatagcccatgtgccgcttaccaggctggagagaggctgtgactcactgtgtctgtgttccgttccagcaacccactgaatactttgacatggggattttcctggctttcttcgtcgtggtctccttggtctgcctcatcctccttgtcaaaatcaagctgaagcagcgacgcagtcaggtagtgcctctgtgtgtagcccgtgagcagtaacccctcttgccgtgacactggggaaaaccaggactctcgtcaccttattttttgatggtgcaacatggagcctcacagctgtggactctgagctctgcagcctgttcccagtggcctagaaactgcaaagatggaaaaaaaataagagcaaactaggccaggcaccatgactcacgcttgtaatcccagcactttgggaggccgaggcaggcagatcacttgagctcacgagttcaagaccagcctagtcaacatggcaaaaccccgtctctaccaaaaatacaaaaattagctgggcatggtggcatgtacgtgtagtcccagctactcgggaggctgaggtgggaggatcacttgagcctagagggcagaggttgcaatgagctatgatcacaccactgcattccagcctgggtaacagagtaagaccctgtctcacaaaaaaaaaaaaaaaaaaaagatcaaaacttacagcccagtgccttctctgttctaaaagggctagtcctacaaaggttaagcattgggaatatctccagcaggtgtttcgaaggaagtgtttattttatttttttatttctttgagacaagatctcattctgtcacccaggctggagtgcaatggcatgatctcggctcactgcaacctccacctcccggggtcaactgagtctcatgccttagcctcccaagtagctggaattacaggcacccggctaatttttgtatttttaatagagacggggttttaccatgttggccagcctggtctcaaactcctaacctcatgtgatccgcccgcctcggcctcccaaaatgctgggattacaggcgtgagccaccacgcccgtcccaaaggaagtgtttaagtcaacgttaataagtattataaacactccacaggtctagaatatgtgctgtagcagtctgagttttgagtgctttctctgaagtctattctggcatgattgagaagtgtttgcctgtcccagtacatcaagtggcgccctagagccttggtcctcagatagaatctgtggtccagcagcaacggcagcacctggaagcctgatagaaatgcagggtctcaggctccgctccaggccacctacacagtataccaggctctctgggtgatgcttgattaacagtagctgctgtagcactgcagccacatcactttgtgcttgcaggaaggagaaactcgggtagggggtggtgagaggataagcagagatctggacccccaaatgtatggcagggtcatgtctcaggggagagatggtggatcttggaaggcaatctgtagagaagagaatcaccaaagttctcttgagggttgagcgaccacccccaacaagatgatggcttgtgttttttgagcacagcctatttgccaggtgctaagcacttacacattgtctatttactgtcaccacctccttcaacagaaagaggaggaacgcttggcgtagaacaggttgataactcggggtctggcagagttaggaggcagcaggtccaagtaattggaggagacccctgccttcaaatcagagagacccctgctagtcttgccacttaggaaaagcctaggttgatgtcgtggacaccccacgcgtctggagaatatgtgctatggcagtctgagttctgagcgacttctcagaagtctgttccggcatgatagagaattgtctgcctgtcccagtgaatcgtgtgtcatgtccctggggtgactgccactttcatacgtactggaccctcacacagactacattctgccctgcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggtaatggcagaagcaggcccgtcctgggtggggaaaacataggcaggtcagcagaggtgcccaagacctagaaggacagggccctgtgttccatcacacacatcaacttttagagtcactcttctgaaaattctgagacttgacttgatacttagctgggtgtttttacttacaaagagacaagggattttatatccctcacttttttttcttgtagctctttgaaaattttaggcctagtaccatgcctgtagtcctagctacttgggaggctgaggtggaaggatcacttgaggctaggaacttgaggctgcagtgagctattattacaccgctgcatatcagcctggacaacagagtgagactttgtctgtcttagaaaatttcagaccttcagaaaagactagtaccatagacgatatatgtcaggggcctagaatcatccatgatgaacattttgccacatttgctcactctccctctctctagacagatgcatacatacacatatttgcggggcagggagcaaaccacttgagaattacagacatttgatgcgcctttgttgaaaatgttccactgctgcagagactgttggatggaaatggaatttttgcagaatagaatagtagattcttacacagactctgggttctaatcctgacctgggtggattctagctttgtgatcttgggcaagtgacttcgttttcttgtgacatgggcctgacactgaccagcattccaggtgatcatgaaggttccatgagaagatccagggtagaccctttgtcattctgtcaggcacagtgttaggtgtgagctggaatattactgtactagacaggtcagaaaattgaaagacaaagtaaaatgagcaaatctggaagatgcttaggcttaggaactctggaggtggttctgtcccaataactctatctgtctagataggctgcttttcttataaaccacacaccccatggtgaggttcaggatccagtaaaggaggggatagcagagctttacccctttgctgccacacctgtcaatcatgagtcccaggtatcttcctttctactcatgcctatttgggatacccagggacagccagcacctcagagatgcagaatatcttggggtatacctggccctctctccatacccctaagcctcccatcctcactagcaggaggactcggccctccctgggtggaggcatgagtgtgtttgccctcctccagctacgggaaagacgcctgcctctgtgcgtgcccactcccttaacactgaggactgtggatggggctgactgctggcagtttccttcttcctagaacacatgggtgggccctgcttctagggaattgagccctaattggaggtggggaggagagtagggaagggcacgggcatgctgtgcagaactccttggtctatgctggactctgcaggaggacacacctgcgaggctgaaggcagacttgtgtcccctctctccctgcccaggagctgcgggtcatcccctgtactcaccggtttcacaggaagtgcgtggacccctggctgctgcagcaccacacctgcccccactgtcggcacaacatcataggtaactgtcacccgccttagccattgctgaagagtcaagtgcctagctagagtgtgacacacaccgcaggcttgggaacactcagaaccaccgtggcactgccctctggacttggaggcctggcagccctgggttttggaggttgtctgcacgacccttaggagagcttggcattaagaatcaccctgagttcaagtttgggcttcacattaagcagcttcttgacctcgggcaagacatctggcctctcctaggcctgaggcccctaatctctttagtggcaatgacagtaatggtgtttgcccacacccagtaccatgggggtgttcctaggaccacgagagacgatgagtgtgcagaggccagcttgggctgttgctcctgcatcactgtgtcattaaacagggatggagggacactggcatctttgaatccgattcttttctgcagacttctgtggtgccctgtcaggcagagcagtggggagttgggagcggggcccttacaggagatgggccatttcacacagacaggcaggtcagcctctgccgctgcagctcagtttgggggcagggttgtgagaatgggtaccttggcaggtgaccaagcctgctgcttcagcctttgcccgttttaaaaatccctttagcctctgacaccagtatgctcagccctgcctactctgtttcctccacttgtctccagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggtgagagcaggaaatggcagtaggtcagagcaggagtttccatcagggtcgtcttgtcttctgtcttaggcattttctgaatgacttcttttgtgtccttggttttaaacaccatctgaggctgaagacttccaagggttactcctcagcctggccctcccttggagttcagacccattgagccctctgcttccatgatctcgggatctctccccaagatgcctgcagcctgtcatgtccacagcagtactcatttccccctctgccctgctccccatccgcatgctcacaccaaaaacctagcaccagctgggggtagtggctcatgcctctaatcttggctcacccaaccactttgggaggccgaggctgtggatcacttgaggccaggagttggagacagcctggccaacatggcaaaaccatggagtcggttcatgactcctcatggctgggatattatgtaggagccacttcataaacattctcgttactcagtacaaaagttagccaggggtggtggcgggtgcctgtagtcccagctactcaggatgctgaggcaggaaaatcacttgaacctggttggcagaggttgcagtgagccaagatcaagctactgcactccagcctgggtgacagagcgagactctgtcttaaaaaaaaaaaaaaaaaaaaaggcaggacccagtggctcatgcctgtaatccctgcactttgggagggcaaggcgtgtgaatcacttgagttcaggagttcgagaccagcttggccaatatggtgaaaccccatctctactaaaatacaaaaaaattagctgggcgtagcgggcacctgtaatcctagctactccggaggctgaggcaggagaatcgcctgaacctgggaggcggaggttgcagtgagccgcgctccagcctgagcgactccatctcaaaaaaaaaaaaaaaaaaacctaggccccatccctgtgcccaccctgccccttgcacttcagcctcctgggcttctcaacccgcctgtgaaggaccccagttgcttgtttttgcctcagtccatgaaaatgaattcccagaaaatgaaacttagcaaaagacatgtaagatacaagtccaggtattttattattagattcaacagacatcagattgctacaagatttccaaacatgctgtctcagtaataaactggagtctagcacctctgagtagcactgcaacaagatctacctgcaaagtacatcccaaatgtatctacttctctgcactcccactgctatcccctcagtccagtctcattttcctctcttcgggacagaggcaataacctctgactgatctgctgtcactggtcttgccttctattccacttggaaccagagtggccttttttgaaacataagttgatgtctttgtgctagaaaacccttcaatgacttgccattacctttaaaatcttaaaaatgttggccgggtgcggtgattcacgcctgtaatcccagcactttgggaggccaaggcaggcagatcaccaggtaaagagaccgaggccatcctggccaacatggcgaaaccccgtctctaataaaaatatgaaaattagccgggcgtggtggcgtgtgcctgtagttctacctactcgggaggctgaggcaggagaatcgcttgaacccgggacgccgttgttgcagtgagctgagatcgccccatcgtactccagcctggcgacagagcgagactccgtctcaaaaaaaaaaaaaaaaagttaactcctggctgagtgctttggaaggccaaggcaggaggatcacttgaggccaggagctggagaccagcctggggaacatagaatgaccctatctcttaaaaaaaaatttaaaaaaaaatttttttttaattagctgggcacggtgacacatgccattagtcccagatacccaggaggctgagcccaagagattgaggctgtagtcatgatctcaccactgcacttcagcctaggcaacacagcaagaccctgtctcaaaaataataataaatgttagcatctcactcagttctgtgtgatccagctcctgccaacccatctgatgagctcctggttcactctccttgcttcctgctttcacctcctgtggcccctgtcccgttcttcccatgtgccaagctcattccagcccccagacctgtccgctacttttctcctccagatcttaggttaggtaacactccagccccctctgagatcacctacacaccttctgttcacttctgtcatcctattgctaaattactttgtctcaaggttcgtaatctctgtgagggagtcctctctgctgcttttcccaaggcctgacgcacaccgggcacccagttaacatctttaatatattgggctttcgtgctacctgagggcttctagaaagctctctacatccaagtgagaggctggctctccaggaggtacctgtgctctcagcacaaatggagcccctctgggaacaggaacctgcttcagccctttagcatacacaggcctgccacatgctggggacagggccacctgagtcccttgcctggtcccatgtgtggtgccagctccctcccctgatgattgttctctctctttcccaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgtt

SEQ ID NO: 2 - DNA, 173895 bp, homo sapien
agatgaaagggccgcggcgcgacggccgggggagccgagctgagcctgcgacccacaaagccgccgccgccgccgccgtgatggggctgtgaggcgtccgcccgcgttcggtcctcagccggcccgcgactatgcccggccgcgcccgccctccgcgccctcccgccgcaggaccatgaggccgcgctcgggcgggcgcccaggggccacgggccgccgccgccgccgcctgcgccgccgcccccgcggcctccggtgcagccgcctgccgccgccgccgccgctgccgctgctgctcgggctgctgctggcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcaggtagctgcccgccgcccgggccccgcgccgcctccgccacaagatggctccgggggctgcgcccgccgaccccgccgcgggctgcctgactggcgggcgggcgggaggggtggccgagaggccggcggcatccctcccctgcgggcgggcaggcgggcgggacgcggcctccggggcgcatccgcggggggcgagcgcacgtgggggctagagctcctgtgaaccccggggcgggaggggcatcctgggcccggcacccatgctggggcagcccccttggccggttgggtatttaggtctgcctcaggtggaagtcccgggaactacctgttgaatgccaactttgaaaagacaagtgatgagggatggggtggctcgtttcaggttgcaggctttgcttttccatccatgcatgttctttttgggtgcggccaggtttgtctgaagggctgcacaacgtcgggttcttccccggaacctgccgtccgcctcacctgggcgccggtgacccttctgcggggctctggacaagcagcagcaggcaggggaggaggcggagctggtcgaggagtggggatcgggggttccctggagtggcgatggaaggcagccctcgctgcatgcttcacattacagagggtgggagggataccgcctgcccgtccctcggccaaagactgatgcgaaggacctgcaaatggggagatggcgtatctcactgacaggacctccaccttggaccaaatgaaagagatctacattccaaaggaaactggctagggagacctttaagccgtgcctactctttggaggagggactctcaactgaagcttctgcggatggttagctgggtggatgtcttcccgcttccttggccgtgattttatcaacttgttactagacagccagcgcactaataatggcagttaatatgcgcgcctcggatgggggcgattcgtaaaggttggcttgtctttgaatctttggggtgatcggatgtctgcagggcctaagctttgtgggccttctgtgctttactcttgggtgagttatgaatgaaaagaaggggactccatggaatgattgcatagcagcccgcagcgtagacagcctgttccgtggtgtccttttccttccttgggtgcagactcaaagccctgccttcataggacagggagagctgtgcagcttgactccgtagaggtgtgcccttacaaagctggaggaggtacccaggcccatgcgattaatcagcagcattgccttaccgggctcttatccccatccgaaaacttctgtagggtaaatagaagaggaaactccttcattgagccctttgactatctatgttaatgcttttggacttaaaaaaagttgtaattatgatctttataagttttagagatgatgctttgctgaagattcctaaacatttaagtcttgctccttggcaacttcttgtctttctttgaggctttcattgtgtcctgatggttttagaaatgtttgatttacagccttctaaaaaaaaaaaaaaaaaaaaaaaagacgctctagcgtggcacttgactttttgaaggagacttttgaagtttgcagtttttatctgcaatgttttaacgtgtcactctttctcaacagtagtttgtctggtgagcgagctatccattatgaggagtgttatgctttggagataatcttgggttcaccatttaatacaaaattagcagtttaaacaccatttgtaactattttatccttgtgagtagagagataatatgtgaatttggcagaaggaatctattctcttctgaaactttttgaagtgcttatctaactcttttgtagtccattagcctagccaaaaaaaaaaaaaagtcaatagttgctaagtaaagtgacttaaatggtatttaataagtttacttgttaagcaatcactaataggtgtccttaattcccttatagctgcagtaatgttggtgagtttatctgagctgtctgaatagtcatttcatggtgcacctcgtatctttagtaactttattgtggtagctgacttgttgaacctccctgtttctgcggacagagtgcagtgtggctttcagggatgtgtgtgtacaaaggctagcatgcttttatgagttctgcaaatactgtttgattgaaggaattggtgtggaccttgtctggcagccctgaaaaagttttttgtaaggaaggctgatgatgttttagggccgctgagagggaatataacattttcttttggtgagaaatgagaaagcagaaggaataaattgctgtccagctttggattaatcatgttttctaagtaacctgaacttttcaaaacctccttttatttactgtctttaaataaacctccttttgtttactatcttgaaaaacctttataagctttagagatgatgctatgctgaagattcccaaacattttatccacagtcttcaagaatagtttgaatcttaactcttgctcattgtaacttcttgtctttctttgaggctttcactgtgccctggtgacacagtctcattgaacttttcaaaacttccttttatttactatcttaaaagaaaatagtagccaggcatggtgactgacgcctgtagtctcagcattttgggaggctgaggcaggaggattgcttgagcctaggagttcgagaccagcctgggcaacacagttagacctggtctctacaaaaaaaaaaagtagcccagtatggtggtgtgcacctgtagtcccagctatttgggaggctgaggtgggaggattgcttgagcctgggaggctgaggttgcagtgagccatgattacaccactgtactccagcctggacaacagagcgagacactctctcaaaaacaaacaaacaaacaaaaactgtgatttgctgcttagtgttttatcgtctcagagcagagttcattttcctataactaaagctaaatagtagcactatagcattgcttttgttatttccactggggttctgtagcagttttatttattcatggtttaggggagaaaaaacctgtttaggagtgtcacctttaagaattctaagataaggaattcgtttgtattactgatttttaacccccctccttattatatgccaacgaagagagagagagagagtgtgtgtgtgtgtgtgtgtgtgtgtgtgtgtgtgtatacatatatttgtatagtagataccttatcatagtctggtttgcctagataattctaactagagtacctgttcagtcatttccatgggttagggtaggggaagcctagttaagaattgtgtcagtttgtcagtgtcagagagagagagagagtgcaagagggagggaggtagtaattcaaaccttaggattcgtcatcaggaatcttggttcttctcctttgcgttttaggcttaaataactatcccaaggtcaccaatgtaatctgaatgaagaattttttttttaatgtctccatctgtgaaagttgtggtgaaaacaatttgtgggtatgaaatgctattagttacttttattatcttatgtatttatgcagtattaaagcctgtttgcttgtaagagtgtcaggcatacagtttgaatgctggagaaattaattacacttctcctgtagttctgaagtgtgggactttaaagggttcttagatatattgatacatatttcatctttgaaccaatttgttgctgttaatgagatcattatctgaaactttcagacttggctgtgcaactcacatggttggtgatgttaaataaaggcccgattaaacaccggctagtggtatgtggattggttaaacaaagaaaatttgcattgctagagatgaaagattgttttaaagtcgaaatgcattttttttttgcttgaagtcaaatatttagaaaagcttgagaaattcatttgtagaaggaatctgaatgacaggttctgtgtaactttaaattcagcctttctgggtcctaggttaaatgctgaatggacttgaaaacagagagaagctgaggacatttaagaactaagtcagttcctttagctattaggggtgggtagagagctgggtggtgggttaaaagggctgatcaaggtccttaaatatccgatgttaagtaaaggtatcacagagagtaattttaggaaactaattcctctgctttgtttccctgtcagtgtgcttctgcagtttagcatttgatcaaacactttcttttcatctccattttaagttaacttaacaggcctgcctctaaaaattgacttggtctaatagaacaattgtgtgctgacagctgacctggatttagacagaaagggattgcctactgtcttctcagatgggccttcataggttaaaaccaagcatttgattcagggggaaaactggggctgtattttgtgatgttatacattcttagagccccttattttctgttttgttccctgagatctcatgggagttactagtacaattctgaataggaatgaaattggagttcagtgtagagctgtagattaaagggaaagtagtgatggtttcctcttatttatacagagcactgccaagcatgtcatgttttggttcttctcatcctgacactaacatgcaattagcaactattgttaatccattttacagaggagaaaaactgaggctgagagaagcaagttgagttctctaacttcacatggctagcagatgacaaacctggattgaaacccaggtctggccgggcgcggtggctcacgcctgtaatcccagcactttgggaggtcgaggcgggtggatcacaaggtcaggagttcgagaccagcctggccaatatggtgaaaccatacaaaaaaaatacaaaaaaaattagccaggtgtggtggcacatgcctgtaatcccagctactcaggaggctgaggcaggagaattgcttgaatccgggaggcggaggttgcagtgagctgagatcacaccactgcactccggcttgggtgacagagcgagaccccgtctcaaaaaaaaaagaaacccaggtctgcctgggttgcttgttcttgtttttgccaagtgaacagaacttggctggttaggattttgacattaattcaagtctaattttgaacaacatataatataggggttcttaacctgagggtcacagactttcagagatagtccatgaactcctgcaagtgtatgcgtattcttgtctatgggcagttacaactttgcctcttccagggttctgtgatgtgtcccctctatacccacaaggaaaaggggaaactctaatctagtagagcattgaataatccattaccaagagtttgagtggggttcaggctgacaagagttgtacggaagtctacaggtctgggtgcctccattgaacatatttattttgtagacatctatcacagccctattctgtaccagacactgtattgctgttgtcttctggagttcagtctcctatggagacagacacatgcatggataaatgataattcttaccaaatgggtttctccaccgaactgagcccttaggccctgaggcatccattgtctataatgaattaacttccctcctgtgcactgcgcagcatccttgggagaagagagaatatagtcactcaaagacttttctgcatttacatggcaaagtgtaagaacttgacactctgaatgcaggatgtgggaaagcagagtatagttccgtttcatagttcattgaaaaatgaaacggagcacctgtcgctgttgaaatgcctgaagagtagcttctcacaccttcccttgtggacctggaccccatggggtctgtttttgctcatttctggatcgaccccctgggttcccactgcctgctatgcatgaggcactcagtattgaatgaataaatgatggagagtggacatcaggcaggcagtgggttttatggattatttatgctttaattgatgagaacaacttgctttggcttggctaataaattctgggattatccttcctttttgattgttatttccagaaacttgcttggatggaaaggatagctctctctctggttcccatagacccactggtattacaatactgggttgtatgaaagtgatctggcccggtgtggtggctcacgcctgtaatcccaacactttgggaagccgaggcgggcagatcacaaggtcaggagatcgagacaatcctggctgacacggtgaaaccctgtctctaccaaaaatataaaaaattagccgggcgtggtggcgggggcctgtagtcccagctactggggagactgaggcaggagaatggcgtgaacccaggaggtggaggttacagtaagccgagatcacgccactgcactccagcctgagcgacagagcaagactccgtctcaaaataaaaaaaataaaaagaaatctgtgtggggtgtttatattccaaggcagggtacctggcataagaaaagtctgaaggtgttcttttcctgatgaaactgagtattgacaaagccttaaagtggataggttatggaaggaaagaatcttgaatttccagtgtccctgggagtaacaataagggattggcattcagtatcatcgttaacctaaatatatgccatgtgaaaaactttgctgcttgcttgctttctctctctctctctttttttttttgtcagggtctcaccatgttgcccaggctagagcacagtggtaagatcatggctcagtgtactcttggactcctgggctcaggcagttctcaggcctcagcttccccagttgctagaattacaggtgtatgccaccataccgagctaattttttattttttgtaggtatagggtctcgttatgttgcctaggccggtcttgcactcctggcctcaagtgatcctcctgccttggcctcccagtgctctgggattacaggtgagagccaccatatctggtcagaactttgcttcttgatggtattttcccaagtctggagagtttggatttctaatttgtgacatttaagtaaatcttcataatcaaaagaaccagattcagtcctttaatgtgttagaaaggagactgaaatccagagaaatgctttgctgaagtccacataaggtagagatgacccaggattaatatttgggtcccctgactcccaggcttggagcccttctgttacccccggctgtagcctggctgagtgtgacaggggacaccagatgcagggcatgctttatgatcagatgtataattgaggaaagccaggcattcttaaattgtatattgggtttaagtggttgcttttcttctctaattaatttagattttgagtctctcagtcttcctccctgtcagagcttttaaaaatagctactaatgatcaagtgcttattgtgtgccaggcactgggcacagtgctttgctcacatttaacagacaaggtagatggcatgtgccagagaggtaaagtcacttgtcaaagtcactgagcaagtcattagtgcagctgaggttcaaatcctggtctgtctgattctaagccatttctgttttcacaagcccgcttcacttcacactttcttatgatgaggttatgggaactgatgtggaatttagagttgagtttaaacccaaaacgattgaccaagaaataagtctataacgtcaactgagaaaatcccctatcctcacaaagatgtatttccttcctttcttttcctcttctttttttaaatcacaaaagtctcattctaacttagttttttccataaagagccaatctaccaggttcacaaagagggaccagtgacttgacatatataactgtcactcgatggcacttctgttgttttcagctattgggcaagctggaatggctgtagttttctggcatttaaagggatttctggtgtgagacacacctccttcctgtggctgacttttatagcaatttgggagtctgcatgtctttctccaaagaggtcacgtcccatgtttgtgacctttcttactttgcacaggctcattgaatcctcttggttgttaaaacttaccacgagtgctacatgcctcagtgggcaaacattcagtggtgccccccgtccatcagatcctttgtggggcaaggcaatgaacacaagagtaagacttggtccctgcctgcaggcagctgagtgtaggtgtccagacagcacacgaacggttaccttacagtacagtggggcatgtcctatctggtaggaaacagcctataggatactgaagaacacctgggggagggaatcgggccctggtgctaagtttagacctgtctgtcactgtatgagcattctggccttttccaactcatttttacctacctttgaggttaaagctgataacctctttgaagagaggtgcctttatacctttctaacggaataggaaggaggtagagagtagaggttctttgttctatttgtagcttgaatgagatgttttaaaatctgactttcagtggctctgtttactcatgatagtgtcaaaagaataaggtcagctggcccattgtggttcaaaggagagcactttatttttattgcccttaagatgtgttgtaagacttgatattaatttcctcctctccccagcagccagtgtaatatagttgtttagaaactcagtatagagtttgattctgtgaaaacgaagtttgatcctagaattttgatgggaaaacgtatgttagaatggggacttctggcctcctggtgcagaagtgcctgcatttaaaaaataaaagagccggcgcggtggctcatgcctgtaatcccagcactttgggaggctgaggcgggcagatcacgaggtcaggagatcgagaccaccctgactaacacagtgaaaccccgtctctactaaagatacaaaaaattagccaggcgtggtggcgggcgcctgtagtcccagctactcgggaggctgaggcaggagaatggtgtgaacccggcaggtggagcttgcagtgagccgagatcacaccactgcactccagcctgagcgactgagcgagactctgtctcaaaaaaaataaaaaaataaaaaataaaattaagagtggggtagtactcaattaggtgtgtgtaagttcccatccagcactgtaagaattttattataacttaattttctacttgagttaatttggctttgctatcttgtcagcaaacatttattgaatgtttactgtagataccgtatagagaagaaacatcggttttatgcacccgtggtataatttgtgcttttcaaatgttatttttctgatttattcgagagtttgaggctgcagtgagccttgcagctaccagtgtgagccaccgtgccagcattggtaattttctttctttctttttcttttttttttttttcgagacaagttctggctctatcgcccaggctggagtgcagtggcgtgatcttggctccctgcaacctctgcctcctgggctcaagccatcctcccacctcagtctcccgagtagctgggactacaggtgcacatcaccacatccagctaatgtttgtattttctgtagagatggggtttccccatgttgctcaggctggtcttgaacttgggagctcaagcaattcacccgccttggcctcccaaagtgctgggattataggcgtgagccactgtgcccggcctgccttggttattttcataagatttctagaattaggttcactgagttaagtgatataaacatttttgaggcttttgctacatatttttagattgctctacaggagtggtctagtttatacacccctaccaggtcgccatgtatgtttctacacaatagccctgctcgcaacagatagtatattttgctctgttgcccaggctggagtgcagtggcgcaatctttcttggctcactgcagcttgaaatctcaggctcacaagtgatccttccgcctcagcctcccaagtaactgggactacaggcatgcaccaccatgcctggctaatttttttttttttttgtagagatgggtttttgccatattgccaaggttggtctcaaactccagggctcaagtgatccacccaccttggtctcccaaagtgctgagactataggcgtgagccactgtgacccactgtatgtttctcaaaaatacaaaatgtcgtaaaagtgaaagtctatatattcctatcatttagtaaatagtaaaatactggctttttttttttttttgtctgccataaggatctgaattatgactaatgtctgcactgaagggaaggtacctggcgtggcatctgggtgcctcccttgtaggtgtatcagagcatgattcaggagcagcaggttgcccttgtattctgggcaggaacacggcgtctgtccaggcagatggccatgctcagaggcctcacggtggggaccgctgtgctgtcgtcacaccctgtggcagcagattgttgcccaggagggtgctgcttcagttgctggtttctgcccttcctctttcctgtcgagcaggctttctgcttctgaacaggctggattcagaaaggccgaatgaatctgtccttgaattcatagtgacactgtcagttggtggtgggcagagatgcaagttgagcccaagcaccagactctcaggggtgcatttaagcagcaagcatataggctgaaaacagcttccaggtattttgttcgatcgctgttaaaaatctagaaagtgtacataaaaatgggctcttctaaaaaaaaaattaaaagatctggcatcagtgggtccacagtcccatgaggcaatagcctgccatagtggagtggcagctgccccccttcagcaggtacacaggccctccagtcacaagtccttatcgcattgcccagcttacttccctcactgacagttccatttacagatgcctggccctgtagacactgtagctggccatcctttctgtctctggaagttccaaagttgaaagcttttaacttgtgcttggcaagtctcttttctctccttccccaaccaacctgagtgtgagatgtccatcagtggaccccatgagtctcaagttatgctactgaggaaggcccagctacccttgatgtgaccagagggctctttttgctttggtgtaggtgttgaaggctgaagtctggagccattggcctgtgccttcaggatctttgctccttctctctttttggctccatggtttctcaactctgagacttaattgtttgtgctgaagggcaccttgaaaatgctgtgactccggccgggcacggtggctcacgcctgtaatcccagcactttgggaggctgaggcgggtggatcacgaggtcaggagatcgagaccacgatgaaaccccgtctctactaaaaatacaaaaaattagccaggcgcagtggcgggtgcctgtagtcccagctactcgggaggctgaggcaggagaatggcatgaacctgggtggcggagcttacagtgagccgagattgcgccactgcactccagcctgggcgacagagcgagactccgtctcaaaaaaaaagaaaatgctgtgacttagctctccttttgcagtgagggaactgtgggcaagggcatctagcctttggtcttaagagctgggattagaactcagaacttggggttctcgggggaggggtggtctttctagaatggcattctgctgcgatggttgaattccagaaaatcttccatgtgcctgttgctttagggttcctggtgtactttcacttacagtatcttagttcatcctctcatttgggagtgccttttctggattctgccccagaaggctgtctgctgttcaggtggtctgaggcggagtcttgctctgtcggccaggctggagtgcagtggagtgatcttggctcactgcaacctccccatcctgggttcaagcgattctcctgcttcagcctcccgagtaggtgggattacaggcgtccaccatcacgcccggctaatttttatttttatttatttttatttttatctttttgagacggagtctcgctctgtcggccaggctggagtgcagtggcgcgatcttggctcactgcaacctccgcctcccgggttcaagcgattctcctgcctcagcctcccgagtagctgggactacaggcgtgtgccaccacgcctggctaatttttgtatttttagtagagacagggtttcaccatgttggccaggatggtctcgatctcttgacctcgtgatccgcccgcctcggcctcccaaagtgctgggcttacaggtgtgagccaccacgcctggcccctatatttttagtagagacagggtttcgccatgttggccaggctggtctcaaactcctgacctcaagtgatctgtctgcctcagcctcccaaagtgttgggattacaggcgtgagccactgtgcccggcctgagaatgcttttctttgtacctaatttgtatacttttctttaaatgcatttgacattgtgtgtttagcacctttatgggatttctggaatatcgctgggtacctggagacttggcatcttttcagaaagtacatcagtcttggagtaggtggtgagcagacagctaatggcatgtaaagaatgttgcaagcttgacttgcaaagctatttcaaaatttaaataaaggtagcttgtggctgagttgaagggaaatggtggtatcttcaagacaatgcttggcttgctctgcctcttgctgacttccctcttcaggcctgatgctgcccaagctgtttccctgtctctcattctctctcttttggtttttctttttctttgtttttaaaagagaccaagtctcactatgttgcctagactggacttgaactcttgggctcaagcgatccttccgtctcagccttccgagtagctgggactatgcaggcatgtgccactgcagtcggctctcacattctctttcttcccatcagttcttcccttcccttcagattcatccttctaaagtagtgtttggtcacatcagtctcttgatcaaaatctttcgtggcgtcctgttgcttactactgagctgtgtgaagaggtgacctagctgccccagtctctcattgttgcctccgggcgtgggcctgtgtgttgctgtccttgttcctgagtgggtcctgggctttcctctctcagtgcttttctttcttttttagggggatcggggagacagaatctcactctgtcacccacccaggctggagtacagtgacgtgatctccgttcactgcaaactctgcctcacgggcttaagcagccctcctgccttagcctcttgagtagctgggaccacagaaatgcgccaccacgccctgctaatttttgtatttttagtagagacatggtttcaccatgttgcccaggctagtcttgaactcctgagctcaagcaatccacctgcctcaactcccaaagtgctgggattactggcgtgagccaccgcacctggcctgtgcctttccttttggattgcctgctgtaatacgtgtcttcacctccacattttcaactcccgtctttgctttccactgtctttttcctgtcctagctcctcccatctgcagccaaactttcagtccttcccatgaagctttttcctgggttccaccagtgtgttcctttgaatcagagcactccatctccctattgtcttggatgtaaaacatgtaaattatttaccgaaccggaattctcctagatcacactactttgggatagcatagtgagagggatgtgaaaggggtgttaatgtggcctgcagaaaaaaaggcttggctttttttctctttttttaggtggggtctcactctgtcacccaggttggagtgcagtggcacgatctcatctcactgcaacctccgcctcctagtctcaaacgatcctcccacctgagcctcctgagtagctggctgggaccacaggcacacaccaccacgcctggctaattttttgtatttttcgtagagagggggttttgctgtgttacccaggctgctcttggactcctaagctcgggtgatctatgcacctcggcctcccaaagtgctgggattacaggcgtgagccactgtgcccagccaagacttgtttttttgagggagaattttctgtgattgtcgcaactatttgcaagcagctttcagacatggtgtgtcctgattattccaaatagttgggatagtccagactctcaaaataatttcaccttgcctgtgcttcctggaggtctggagaaaggagacagtaggaggtgacaccctctggctccttccagtctggcgtgtgcctgccctgggaacattgttcagaacatgctggagaagagaatatcacagcctgactgtagacttttggggatgtgttttatttaaatatgtaaaatataatattttggtgtcacttaaaacaccgggacttttggaggcgtagtagaagttctatgtagcttcagaatgacccatcagaaacaaatgtatatgagtctttacttacatttgtgccatattgcttccccctatatttttttccctttggaagctctggcatgggccttgatcctgtgtttaagcgctgtgtgggaagcagaatttaaaaggactgtagtagtatttctaaagagacttaacaggctacatgtgagagaattttagatttcaatttagcaaacgtttgattttctagtctttatggggctgactgtaagcatttgggaaattattgaattattgcttagttctgtataagttgacatgctgaggttttttttttttttttttttttttaactgtttttgtgggacagtggtgattacatgggcattgggactttcaggaatattccagaatctatgatatgttgtatttcacttgtgctagagggttttcaggctgccttttcatggcatgttcactccagaaatgctctaatgcccatcaataaatgtcaccctcatcctaggaattagatgaagagattatagttttgaagttttggtgttattaggcttaaatctctaggacacatataaacacacttgtggtattaaatgtgccgggtgggtgatttcaagttccagtggcagtggtaatttttgcatttcctgactcttgtgtttaaatttgcagtctcaacattgcatcactgtaagttttcacatttaatgaatatttatgttgagccaagttctatacgaatgtggtggtttctgacttgattatagcttgctgtgtactgtggccaggagtgccctacagacaacagagttggcacacgtctcagcatgccaagccccggcggatgtggttagggaccacggtgactggggcattggttgccataccaaccttgtttttggaagggaaagctctgaaacagcaatgggatgggggcagaatagttttgaatattccaagtaaacttattccctatatgttccctgcaagaagatgctatagaaaactataattcttactatgtgctcagatagcatgagttaattttctttcttttcttctttctttctttcttttttttttttttttaagacagtctcattctgtcacccaggctaaagtgcagtggtatgatcttggctcactttagcctcgacctcctaggctcaaacgatcctcccacctcagcctcccaagtagctgggaccacaggcgtgcaccaccatgcccagctaattttgtttatgttttctagagatgaagtctcagtgtgttgcccaggctagtctcgaactcttgggctcaagcaatagttagtttacttttgcaaggctgttttaattgtccttttgcaaaggtgtggaagttatatggtgggcctttcatgtgtgaatttcttccctacttgttggagggtaaacaggggatcttctatctcttcctattacagaccttcttctctcaactcctgccaacctcccttgccctctggtaactaacctagtgatgactgattgggggagggagaagggaaagaaaaacaggaaggataaatgggggactcctcctcccccagctccttatttatattcctcactttcccttataccaagatggggtttccttgctcctccctattgtatataagcaaagatcacagtcgaaggtgccatcacccataagtgggatgttagggtgccctgctcacgagcttcggcagacagaactgggatgagaggaaggaaacatccctggcatctcacactggaatgctgttacctctttgcaaatggtgccttgcatgattaattctatggtacttggtattgtgcagtaaaatgtctggaagggaattgatcaagtctggtaagccagatcagagcccagaatggcagagtgggatgtgacttgcaggtggcatctgctgttctagtgcctctttacagaagatgatccaagtctctggaagctgccacctgtccaggttcaacagctcaggcagtctgttgttgtggagggcttgtcctcaagcctcatcacacaaaaaaagtaaaaaccccacccctttgaaaagaaacttactgtttcagaagagggaggcagtccaatgatttaatctttgcttgctgacttggagccaactccccattagattgtaacctccttccgggcagggttggtgtttcaatctatttaacatttttcagctgggtgcggtggcttacacctataataccagctttaggaggctgaggtgggatgatcgcttgaggccaggagtttaagaccagcttgggcgacatagcgagactgttcctacaacaaattttttttaaaaaaattagccaggtatggtggtgcacatctgtagtcttagccacttgggaggctgaggtgataggatcacttgagccctggaggttgaggctgcagtgagctgtggtagtgccactgcattccagcctgggtgacacagcgagacctgtctctacaaaaataaataaataaataaataatttttttttaaatgcagaaaacatttcccagttcaactcaaagagcctctttgtttgaatttggaagagctgtcccttcctgaagatacctgaattctattttctgctcatcggtcataatgtgaatctaggatgagcacagatgtgaacggcacctcctagagttgtgcggtgcataaggccaacgcccagaaggcactcttccatctccctgttggctgacgtggcacctgagttgttcccccttctctaatgcttctccttcagcaattgtgatttgctgcttctgatttctgtagtcctaggaaaccagggaaccatgtttgttagaattatgtgtaaagttaggggacagagacatcaagggggtgtgtaagtagtttagtatgtggctgctttggctgcttttctgctttttgctggctcctctttagagatcagctgactggcgcatggagtcctcaaattttgggggcatgtaataaatgatggatggacctttttttttttttttttttttgagacagagtcttgctctctcactcagactagagtgtgtagtggcacgatctcggctcactgcaacctctgcctcctgggttcaagcgattctcctgcttcagtctcctgagtagccacgattacacgtgcgcaataccacgcctggctaattttttgtatttttagtagagatggggttttgccatgttgcccaggctagtggctaggcgttttatggtgcagaaatggcaccactattttgtgagtattcctaatcaccaacttttaagttaactttttttttttttttttttttggagatggagtctccgtctgttacccaggctggagtgcagtggcatgatcttggctcactgcaacctccgcctccagggctcaagcaattctcctgcctcagcctcctgagtagctgggattacaggtgtgcaccaccatgcccagtgaatgtgtgtatttttagtagagatggggttttaccatgttggccaggctggtcttgaactcctgacctcaggtgatccacctgccttggcctcccaaagtgctgggattacaggtgtgagccaccgcgcttggcaagttaactttcattcacctggtttgggtataagttctctttagttcttcaaactacaacttttagctgactgtatttaagaggagttgggaggacagagcagtagttttccactttgctacgcagacacccagcatttgccaggccttttttttttctttttttgagatgggatctcactctgttgcccaggcaggagtgcagtggtgtgatcttggttcgctacgaactccctgtcctgcgctcaaatgatcctcccaccttagcctcctgagtagctgggactacaggcgccctgctgatttttgtatttttcaccaggttctttaagcatgttgtaaactttgcagaacaaattggttctgggtttcctttgatgggagaggctgcagagtgctgagtctggagccagacagcttgggtttgaatcctggctttggcagttacctgctgtggaaagatggctttgcctctctggatctcagtttctgcatctgtaaaatggagataaacttttcctagcgttgttatgaggattacatgagttactcacagcatgcaatttatatttagtggggatgaggttgaagaaaatacataatttcatgctgctcctcacatatacctaacgtttatgttgcagttcccaagtggttgcaaattcttattctaaaatggtagcttatcaaagttaaaggaatccaaaaatgccatttactgagaagagaagtggtcataacataggaatttttttttttaacatgcttagtgcctttctacttgcacctatgtcccttctcccctagtgtgggggtctgtgggctccccagggtagtgcttaagcactttgcaagaggtgcaggctgctcatttctccgattcccagttccctctgtttcctgggagggacgctttgctgcagcttcacctgcttatccctactctctacagctagatcattgtccaggccttaagctctgtcagtcgggcacgtgtgcacacacagacacacacacgcacagctggatgtgaactcttgactccagtgtgtttctaggccagcctgcttgttgttcctggttgctccgaggaaaggagggtgctgattgctcctctggatccagccggacgcatggaatgctgcaacatactaagcctgtgctctgggggcctaattacgtgggacttggggcaagcacaagtgacttcagcgcttggtttgatccagcgtgtgatttttgccaaagcaaatactttattaatcttaaccccccaaattagacacattgactttttctaaaaatgggaatgattggagagcagaatttttttttaaatcccctccccatcctgaacccctcctccagcaagactgggctctgcattcctctccttgaatggagaaggtgagttccatcactgcctacctcctcctctaacattcctgaaactaggtgctaggaaattgcccctttctgaaggtgtgttttttgtgtgttttccgcaagaggttccactccttcctacgtcaaggccaaagaaaggatttgccgtcctgatggaactttcctaactgggaacttgtcctggatttcttgggattctgatccagaatgtgtatagggaaaactgttgggtgacttcccatggtgaccttgagtgtgtctgagaggctcagccagaatttcttgtgtggcctgtgagtgagctagcaagccagcgaggtcagtgggccttcccgctcaacaccctgtctctctcctcaaagtgtcttgggtaaagggcatactcacagggtggaattaatctggcgttagagagtgagcttgttcttatctagtctaaactggaaaaaaaaaatgcatttaaataagcaacctaacctcaccccagaaaacaactcctagttaaccttggctcctcttcactcggcctctgtctttaagtctgagtgacctggtgggattgatcagctttgaagtcctaaggtgctattttaatactgttcttttacgttgcaggcttcgagactgatttaactagattctggagggagcttactttacagcattcttaagagctcgaacaatcttgaaagagttaaactctaattagctcattcctaaggtatttaatgcccttattaaaactcaactgctcgttcacttttttctttagtgaatcagatttcttgaggagctgagccttcgctcctcagatcacaggctcacatgttgaagctggcagtgctagaggctagttcctatctgtgtgacagcatttttaatttaacaggaccgcctttgatgttcccaaatatttataggcagctttagatcatttcagtgtgtgctttctttttcttctctctctctctctctcttttaactggagcaaaagttcttcctcatgcaacagccttccttttatcctgtttagtttatttttgtttcctttgcagctttggcgaaggctgtctggctgcattcacacacacacatgagattgacccttctttttgcttctttggtaaaggctacctctctgtatcctcctgcctgcttgagattgcttaaggcacttctgttcatcccttgactttcttcaggctgagttttttcctaatctggctcaggaatctgttctttggctgacctgagagctttcagactatcatgcagacctgggcattgtgtgaaagtgtctttttttttttttttctgagacagggtctcactctgtcacccagactggaagtgctgtggaatgatcatagctcactgtcaccttgatctcctcaagtgatccttctgcctcaacctcccgagtagctggtactacaggcacctgataccactcccagctaattttttcacttttttatagagatgaggtcttgctttgttgcccaggttgatctcgaattcctgggctcgagcaatcctcctgcctcggcctcccaaagtgctgagattataggtatgagccacctcacctggccttgaatgtgtctctttatggatgaccaggctgtaatatcctactctgcttgcctgcattgacactgatggggcctcagcaagttatgatttacagtgtatgttttgcagatactgttttagctggggcaggaaattcagatagacagaattctgtcctgatcatttcaggcttgctctgtttggctctgttagacttcttggctgaaaataacagagaatcaaagattttggtctcagggatgggaaaaacagggctgcaacatagatttgttaagccattaagaaaaagaaaaaggaaactttgtaccaatcaaaacaaatgatagaacagaggatagtgcttcctccagcttggcctctgggtaaacattctgcttgtgaaacaatccaaattactgaattctcagctgctgttacttacctgggcctggcagacagaagaccagaagatatcatggcttcttccatcattgctggctgtgcctcctattaggtggaagccttttagtgctgaaggtctcataggtggttgatgaaatgtgtgaatgaatgaatacactattcttgggaccttatactgtttttctcactagatccttaagaggattctgagcgataagatatttcatatctgtttttttagatgaggacactaaagtgcagagaggtttatacagctggtgagtgaatggagaagctggcctggagctcaggactgtgtcttatagcctcaccatgaggtaattggaggcaggtaaatccaatggcagtctgctaacctcttagagctaaaaaagcctgttgaggctaagcatggtggctcacgcctataatcccagcactttaggaggctgaggcaagtgaattgcttgagcctaggagtttgagaccagcctgggcaacgtggtgaaacctcatctttacaaaaagaatttaaaaattaactgagtgtagtggtgcacgtctgtagtcccaactactcaggagattgaggcaggtggattgcttgagcctgggaggcagaggctgcagtgagctgagatggcaccattgcactccagcctaggtgacagtgatctgtctccaaaacaaaacagaaacctctcaaggctaaaatctactgtatgttgcattgtgagagttcagagctgaccagattcttgccatgtaaggggcatagtggtggagagtacatccctgagaccagataggcctgtgttttgcatctcagccctgctactgacagctctgtgaccttggccaggtcatccaacctctctgaacctctgcttcttcatctataacatgggacagatagcttgtacgaccaaaagactatgaaaattagatgatatatgtaaggtgtacattaagtgcttaacacatgttcggttggtgtctgttgctacaaaattgtgactctcaaagggttcatagtcctgcaagaaagcatcaggtaaaccacctattagaagacgacttggcagctacaatagagagacgtgctggtgctgagtaggaacccagggcagaaaccactggcttggatttttattttctttcattcagcagatatgtattgagtgcttaccctgcgctggcagagccactggatcacactgattgctgccagctccccctcacctcccaattttctctttcccttcttgggagaatttgagctaaaatgttaattgccacctgaagaaagattttcacggagtcattttcttttctttctttctttctttttttttttttttgagatggactctcgctctgtcgcccaggctggagtgcaggggcaccatctcagctcactgcaacctccgcctcccgggttcaagcaattctcctgcctcagcctcccgagtagctgggactacaggcacacgccgccacgcccgtccagttttttttttttttttgtattttagtaaagacagggtttcaccatgttgcccaggctggtctcgaactcctgagctcaggcaatctgcccaccttggcctcccaaagtgctaggattacaggcatgagccaccgtgcctggccacatggagtcattttcacataaaatgccaaggtgccaaatggcacagccacactgcatttgaccatgtatcttacatggccttgtgctgtccttcaactctcattttaatcttatctaattttctccaatttctctggtctcttctacatgaaaactttatggtccttgagaatgtacaagcgactcaccaagggagcaggtggtggccgcatggttccccacagtgcccagatggtgtccgtgcctttcatggtctggttccatggggatttgttgataagattttgctttcatttggttttccaacccagcagcatatttagatttgattactggtactagcttttttctctgcagagtttcattgtctgagtcactggctgtcttgaaacataagtcccattctccacacccctgtacccctttgcaatcagtggggatggttatgtggtagaactttttccctgcccacagcgcatggtgcagagtggtgtcagcacactttcacttgctgagttgattggtaacatattgaatctagaacaaaagatacaattgaaaagcatttgtggttgtctttgtatagttacaagcctctaaaatagatttgaggtcatttctatgtctttccttttgaattagcaagcaagctttcagagggaagtgggcgttttctaaatgcactattgatttgaagctaacatgatgctctacttttggatcatgaaaataatgttaattttttatttggctgtttggagggaccactggagtaggtcatttatattcaactcttattcatgctttctttaaatagcatgtttaatttcacattaaaactagcttctgttcagctaaaacaaaaactgaaaagatggtttggaagaaagcaaaatgacagagaaaatgcagcatgcaatggaaattggctgcaagtcatctccataaggtgattgagaatgaagtgaagctcagctttctttccaaagaaccctcaacaaccctctatgttaacttaccttctcctgggagtcttggtggcctccttttgtccttggtgtatgttgcatgccaatcatgctgtagagaaggcagtaatatctagaaacacatcttgaactagcgttgggccgtgtgcaagtctcttttggtggggatatgcgagagtcactaactagcaacctttagggaaaaagaagtccaagagggttgaattagtaaccactggggcctgtacgtggtgatgtttgcttttttaaatgatccttgtggagcatcatttgccctgtgtcctatggggcatgtcaccccattccctggatgtcaaaactaagaacagaagcaaaatccattctgcattggctctccttctttagacttagccggattgctggatgcgcggtcagttggatgcaaatttgcttttgctaaagaaaaagaaggcctgcattaataatacaatgataagacctgtgctttcagtttgtgttttttaaagcggtgattagatttgtctgggtggagagcaaagatgaagctattggtctagtagagaccattggtccccagatgagggcctggtgtctccgttgggtgttttgtttgtttgtttgtttgtttttgagatggggtcttgctctgttgccaggctggcgtgtagtggcacgatctcgactcactgcaacctctgcctcctgagttaagcaattcttctgcctcagcctcctgagtagctgggattacacgtgcacgctgccacacccagctaattttttttgtgtgtgtgtattttagtagagacagggtttcagcatgttgcccaggctggtctcgaactcctgagtctgcctgcctcagcctcccaaagtgctaggattacaggcgtgagccaccgcgcccagcctctgttgggttttttaggcacacttgtctgaagaaagtcttttgattttgagccactttttagagctttgaagctcttcctgattttaactattgctacctatggaagagttgctctttgggaatggacagcaacttggggctaacagcttttaagcatggacctctcctgggggcgtgttgggcctgtttactaaccttactgtggactccgccttcagatcaggatgattttcatggtatttttttttttctcagaaaataatcaaaccaaaactttcccttgctgatacagagtgactatgcaaatcaggtctgcatgcttatcttcctagaaatgtagttcagtgaaaagaaaacagcgccttcctttagcccacatactttcctcattcataaaatgaatcagatgaaacttgatttcacccaggctggagtgcgggggcgtgatctcagctcactgaagcctccaccacccaggctcaagggatcctcctgcctcagcctcctgagtagctgggactataggcgcatgccaccatgcctggctaattttttttttttttttttttttggtggtagggaaagggttctaccatgttgctcaggctagttgcaaactcctgggctcaagggatccattcacctcggccttccaaagtgctggaattacaggtgtgagccaccatggctggtcacgcccagctaatttaattttttttttctagagacaggggtcttactatgtttcccaggctggtcttgaacttctggcctcaaatgatcttcctgccactgcacctggcctgatttgtatttgggagcctcactttctccattaactttttttttttttggagacagagttttgctcttgttgcccaggctgagatgcagtggtgcaatctcagctcactgcaacctctgcctcctgggttcaagcgattctcctgcctcagcctcctgagtagttgtgattacaggtgcccaccaccacaaccggctaattttttgtgtgtgtttttagtagagacggggtttcaccatgttgaccagattggtctcgaactcctgacctcaagtgatctgcccacctgggcctctcaaagtgctgggattacaggcatgagccaccatgcccagcctctccatcagactttggatctggaagatagtaagaaaaaaagcaaagtaacttagttctgtcctttcctagaggacgtaagcagtcttggcctcttcatgatggtccactttgttaccgaattattgggtacaaaagtgaggtctgcaacaggctttggatgtttcaaggtgtgtctggctgtggtttgctttctgagtgccagctttaatgtcctcttattttctggcaagggttgatggatgtggcactgaatattttctgaatagtgttcacagaatcaccgagtgaatgctggcctcctcctgcatgtctgttgagggagggcttatggaccagtgggaaagtcagatgtgtccctgagatggtgacagtataacatgcataggctgagtgccaaatgcttggggcccagagaaagtgcctagaaatcagagaaaggtcttgggggtggacctccagctggactcttaaggaagattggtgcttggatttgctcctgctggctcttgctatggggaaggcatttcttgctgagacccaggctaggctggcaactagtggagctttttctagcttgtgtagacctggaggctgcctggcatagaatgtgcccatggcagggcggggagaaagaagaggccaagtgaggtgcggctgggagacaacagatctgctatgctctctggtctgtcatttaagtgggatctattggattcagcctttctgagcctcagtctccacatctgcaaactgggtgtggggctagatgagattcctggggggaattgggggatctgcagctgtgcctctgaaggatgtctggggacagaagtgtaagtggggaagaagcacactaactggggaattggggagggaaagaactttggagggcaagttaggggagggataagaggggctttgaatgccagaaaagggtatgtgacttttatcatggagaccagtgggtcccatagtcagaatataggtgatgtctatgtgcatgaccgtgtttttggtgacacaactcccgcctgccctgtgtcctccagcagcatggtatgtaattgcagccctcactgcacagcagtcggcaggcttattcaggggcagttttccagcagtcactcctctcttgagaacagtctggaatgtaagggagtaagtgatgttctagtgacaaccttgaattcactttattaaagataaataaatcacatgccaactctggcctttagctgttattagtaacaaatagctttctacccgtacacttgaccattcatgacaccttggaagaaaattgctgccatggcatttgaccttggttagcactttgttttttctgagagtttttttttatatatcatgagtatgtagaaacttctggggagcaattcctcagttgcctttcgagtcctgcccctaacccctcagtttgggctccatctgttgactgccctgggtttcagaagggagatagtgagtgtgctctcttgaacatggtcctttaggattaggcaatagagtggtaggctggtttagacatttctggttattgacaggccttactgcggcttcccccaaatgaatgaggaatatatttttctaaatccagccagtgagccaaatgagccacactgggataaactttgtttgtttacaaattatgtaagagaagggcccggccattaaattcttctgagccagaattcctagccctcttcaaagttgtaatcaaactaaacaaacactttccacaggaactaactccctcccgagaaacaggagcagatgctcctgggaggccttcagcaactttggaatgtttaaagtagaaatatgtaaccaaggtgaagttgttccagaaacattgcctgctctggccagaaccaaagcacgtgtcagcttttttatttagggcaagaggtgcagaatggactgggccagtccaggcagaattttctttagaatgtttaatttttggttttcatcttaacccggcttctcatagtatcagctccttgtgacctttattcccttctgcttaagtaactctttttttaagcttgatcttatctcttatcttttagctatgctggattacatccggggatcaaggagcccgcctcttaaagcactcaattattgtccctaggaaagatgtcagctgtagcacaaacactccaggggagggaggctgaggctcgccttaacttcattattgtctggataagatagggagaattgccactctccagttcttttggagatccacaaagaccgtccatctaggctcagggacacggttttcttttctttctttttttttttttttttttgagacggagttttgctcttgttgcccaggctggagtgcaatggttcaatctcagctcactgcaacctccgcctcccgggttcaagtgattctcctgcctcagcctcccaagtagctggaattacaggcgcccaccaccacacccagctaattttttgtatttttagtagagatggggtgtcaccatgttggccaggctggtcttgaactcctgacctcaggtgatccacccatctcggcctcccaaagtgctgagattacaggcgtaagccaccgcacccggcagggacacagttttcgaatccttgccgatttgagtctttactgagcggcttgatttatcttggcttgggaagttgtggatttttagaacattgggtacacttgtattaaaatagatgtatactttcttaagccaattgcacatttttctggagtatgcccaagatgagcttttctcaaggcatcgcctgaagaacagcagtcctgcacaatgttctgtggtgaaagggttctatgaggatctatgctatgcattaatggtggggctcagtatttgagaaatactgttgatcctagttttctcttagagatatattctgcacagtagtgaattaatggctctgagaaattctgttgaagagcggtctttcactttatttaatctggtacttcccaaatgtacttgatcacagaactttttctcaaaggactcaaggtgctaggggatatggagtggcgggtagccagtattaggttagtttagggtctgcactggttcagttggtgtcctgttagattatgaggatggaaggccaacaccaagttaactaccagctttccacagggccctgggatagagtcatcaccacctagaatgaatggcctgaacacctttgaactgtggtaggactatttcttccatttcagcttagatttgtggtcttctctataattgggtgatggggtatagggagttgtagtataaaagaaccaagaaacagtgcttctctttgaagaatttaatttctactggaatgggaagattcatgaaggagttaaacagtaccaccgtccaagtaggtatgaaataatgtcaagtagcctgtcttgtaggcattttgtagcctgtcttgtaggcaggtgggggccacaggaagcaggggcagcctttattgtgacttgacttaccaaactttgggtactgtgatggcgggcagataagatagaggagtccccccgacccctgcagccctaaatgcctcttcgtttgccccgcctctgtgtgtaatgtactatgtgtgaaagtctcttagactccccgcaaggtagacattttagagttggatgaaatgcatgataagaactccttctggtactttccagatgtatttgatcccagaactcctttttctcaaaggacccaaagtactggggaacatttggttccttctggaaggagaactccctctggctgatctgcaggcccccactgctgggttggcatcctggatttcgaggtggccaccttctgtgactcttaggccttgagcttggctatctggttttggagacctggtgccttggaagtgctgggctgagttgaatggaagtgcattttccgggttagtctaccttggttaatgcagggaagagtaaataggctctgctgactctagctgcccataggaaggatgtgtgtgacataagcggggctgagatatcccccattgagatgctaagaggaaactgagatgaggagtttaaattcttctccaaatatgtgtcatatttcatagactgttgacatagagcttttttttttttttttttttaaactttaaaagttggaggccgggcacggtggctcacgcctataattccagcactttgggaggccgaggtgggaggatcacctgaagtcaggagtttgagaccagcctgaccaacatggtgaaaccccgtctctactaaaaatacaaaattagccaggcatggtggtgcatgcctatattgtcagctactcgggaggctgaggcaggagaattgcttaaacctgggaggcggaggttgcagtgagccgagatggcgccattgcactccggcctgggcagcaagaatgaaactccgtctcaaaaaaaaaaaaaaaaaaattaggttaacctacctgatggatattgttggcagctgagctctgtctagcctgggacattcagccttttgcctctagctttcgatgaggccccaggctctgctgtgtattaatggtagggcttagccttagttcaggacccatcccctgtcatacccccaaaccccagaggggaggcgttctctttttgcagatgcagattatcagaaatcgttcttccttacactgaaccaaatttcttctgctccttggttctggttctgtcttctagagtatattaagtatcctttggttgctataacaaagtaccactggctaggtggcttaaatgacagacatatttactcatgattctgaaggctagaagtccagaatcaaggtgatcagggttgatttattctgaggcctgtctccttggcttataaagtgatggttttcctatgttttcacgtggccttccatctgtaactgtctgtgtccaaattttctcttcttataaggacaccactcatattgtattagggcccacctatatgacctgctttaacttggtcacctctttatagaccctctctctaggtagtcacattttgaggtactgggggttaggaccttaacatatcaatttttgagagacagaactctgcccataacacagagccattaagacatgatgaccctccagatttctgaaggtgattttcttgtcacttgtcttttccttgctgagaacccccagttctttccgttctttatatgagatggttttgaagtccctcaccatcttggaatcttctggacttgccttagttttggaaggacaaagtggaatactttggactacccgtgatattatagatagaattcattctaatgtctgcccaagcaaacaattttgatgatttccgaaaaagattaaaaggctaaaaatcagactgtacagtttcagtaacagctttaagatatttgtctttaattttgcctgagtaggtctgaccactgacacacacacgggcaccgcccccatatcccaccccatgcatccagtgctaactttatgtcttcttttgacttaagcatttacgttagagttagtaagtgctcaaggtctaagtttgttcaccacccttcctcccttccttcatacttttttagttttaggaaacctagttgggagggttatttcaaaagaataaatgaatgtagagatttttattttttaaatttaaattacatttaatttttttgagatggggtcttgctctgttgcccaggccagagtacaatggtgccatcacagctcactgcagcctccccctcctgggctcaagcaattcttccaccttagcctcccgagtagctgggactacaggcaggtgccactgtgcccggctaattttgtttatttttttgtagaggcgaggtctcactaggttgcccaggttggtcttgaactcttagactcaagggatcagactcagcctcccaaagtgctgggattataggcatgagccaccatgcctggctgagatttttattttttaaatgtaattgctgtctggagagggtagaaataactcagttactggagtataactcattttaggttcataatgtcatgccaacctgtagtgtagttagatttaaaattattagttattctcttcacttttggaaattgtttactttttattgcccttgtgcaccaaaaattgtgtcaaaaaagctcatatgttttgttctttgcattttcagcacttagcagagtgaaggttaaaaaaaaattgttgagtgactaaaggcatcctcttaatcatcttgtgcttatttaatcaggagcatcctgttgtgtctttggtagaattggcagcttggggtttagggattattctggccgctgtcccttttgcttttgaattgtggagctccccacaaagagaccctcagtgctgttcactcttctgctaaattgtggtttgtaagtcctgactgatagttttgacaggctttttctccttaccgtagtctctttagatggagtgtgacgctcttggagttcctttctttgaagatgctttgactataccgcccaggatttccaaattgtagcctttagatgcctggaaccctggccccacacagctgttaggccccctctattctggaggcccgacaacattaaaaataccaactatttatagcatacttttcagtgtcagtaaattataggatgcccttgccagtggatggggtgaacgctcatctgcctgccactgtgtgattgcctagaagcgtcggccaggtggcaggagctcagccccacctgaatgctcccaggtcctcacctggcactcccacaggaaactaaggactgccaggatgtcttggggttccagtagagtccatgtcctttgcgatggagtggttggggataaaacacacacacacacacacacacacacacacacacacgacactaggtatgtgtgctcttgagagaagcccattctgatctaactgccaactcctcaggaggctgtgttgtcagccatctgtgcacagaagtttgctgcatcactggtgagctggggagtgtcctgtgtggtgtccacttaatcttactaggaaggatcccctcatttcaacaaggtaactgaagaatgttaaatctaaatttgggtaagatatactctctgtaggctgaagaatttgaagagtatataaaagctcttatagctgggtgcctatagtcccagctacttgtaaggctgatgcgggaggatcctttgagcccaggagtttgaatccagcctgggcaatagtgagactccctctctttaaaaagaaaaaaagcttttaaaaaggccaaaaggacatagggtctttatcttccctcagctgccccttggaaaggatctcctggcttgccattcagagtacacagtgaggggaggccccctccacagggtaccatttagaacaggctcagtcgttagaacactgcagagggcgtgctgtcccctggccaccaagccaagttgggcttttggggacaggttttgtggtggtagcttttgggttcttcatttctttgcctggactgaacagtgagcagtgctcaagaggcctgttctgttagctggagtttccattgaagtgctaactgctggatcctttgaacctctagcctgggagggtatttataactagctgtttgcgtgcttagaggaactgaagtcctgcctttctgtagtggtttaagagctgtgcccttggtgtgggctgaaaggcaggcctggcgaagtgtggggactcaaatgcccaactccccacgaccttgtttgccttccccctgccctgccagcccagcggcccttttagggttaacttctctgctttggaagcagctggccagtttacactcctccctgggctgtacaaaaatacttcctttgaagtgttaggagaagcggtgaagggtaaaacctggtgaagaataaaacctggagtggggcttgaatgcatttctcttccagggagtttgctgggtgactgagccccacagccttcctcgtaacctatagagctgagtggttctcctcacatagttacagcttggagcctagttgcagctggcatgtgcatgtgtgggtgcgtgcgtgtgtgtgtatgcacacgtgtgtgtatgtgtatctgcatgtgtgcgtgtgtgtgtgtgtgtgtgtgtgtgtgtgtgtgtgtgtgtgtgtaaagtctcctcaaaaggagtatttcttttcaagagagatagttagaatacagccaccaagcttgcctggtggctggaatccctttgaaggcacttttccctagggcgggtctgagtcagggtggtatcctggggtatgtgcgaagctacaatgtttccacttcgtcctaaagtggccagccctgttcttgctccctactggggtaggaaagctgccactgatcccatctctgattcaggtcaaagcacagcagcctaaaagaacgctgggcatgaagtcagtggtgctgacttctcttaaccttgggtttcccatcaataaagttgggctggtggaaataccggattgggggcaccttgagaaagtgcaagacacttctctactgtaaagcctgcagttgagcagaaatggcatttaggataaagaggccaaagagaagaatgccagagcagaaatgagacggaacaaagcttgaatgtcttcttaatccttgagtatttgcagccaaggaggggttggggcaagatgggaggagaggcagctgttattttctagagaagaatgccaacctgtttctccccacagaggggaccacacaagttatttctgaactggagtttgcagtcccttctttcctggaaaatgccttcatatggatttcttacatcttattacactacttcctatctcccttagacaaggagtgtcccttagacagatctaaaataataccatagagctaacatttattgttggcttttgccaggtattgggttaagcacccaacattaatgatctcatttattcctcataacatccctatgctggttgctgctgttgtcctcattgaatagatgaggaaagggaggctggaaaaagtgagatgacttatccaaggtcctcttacctactgatgcaggtatggaaatacagacccggttagacttttagcctctttacttttttttttttttttgagacggagtcttactctgtcacccaggctggagtgcagtggtgcgatcttggctcactgcacctcagcctcccgagtagctgggattacaggcgcgtgccaccatgcctggctaatttttgtatttttagtagaggtggggtttcaccatgttggccaagctggtctcgaactcctaacctcaggtgattcgcttgcctcagcctcccaaagtgctgggcttacaggcatgagccaccacacctggccccctttactcttaagagatgtaagttacaataagcgatgagggggtgaaatttaattctgtgccccaaacctgatcagaagctgtttttaaggaaagaggtggaacattgaactctgttcattctggctgttttgactcatgttatattcatcagtggacttttattttattttttgagatggagttttgctcttgttgcccaggctggagtgcaatggtgcaattttggctcactgcaacctctgcacctaccctggattcaagcaattctcgtgcctcagcctcccgagtagctgggattacaggcatccgccactatgcccagctattttttttttggtagaaacggggtttcaccatgttggccaggctgatctcgaactcctgaccttgggggatccacccacctccccctcccaaagtgttgggtttacaggtgtgagccaccgtgcctggcctattttattttattttttgttttgagacagagtctcgctctgttgcccaggctgtagtgcagtggggcaatcttggctcactgcaacctctgcctcccgggttcaaacgattctcgtgcctcagtctcctgagtggctgggattacacgtgcccaccaccacgcccagctaatttttgtatttttagtagaaatggggtttcaccatgttggccaggcttgtctcgaactcctgacctcaagtgatccacccacctcggcctcccagagtactgggattacaggcgtgagccacagcacctggccagcagactcttattgatcagttatatttcaatacacatgagtgcgttttgccttgcggttactgaaaagaaacttttcttatttctcattctctgtgttgactttacaatagctatgcttttttccctctcattagaaagggttgggaagatggctgctctgtaactgcagctttgttacggttgaaggtcttggtgtcagggattgacgggtagcctgtaccccttggaatccttagctgtaggctttggtctttccccagcctagaaccagacttggcacttacttcaaggggcttgagatcctgtgcttgaccctccttagctcatgggggaaaccaaggcctgggaaagtttgagtgatttgcccccagtcacacacggggctagacccagggccaggctggcaggttcccagcccactggccacatgcttctccttttcacctgaatttcaaacaggagggaagatgaaagggatagaaatgaccagtcagaggagtaggagggctgtcatttgcaaacagtttcttttgatctttgccccattgtttaaaaaacccccaccaaaccacaactggtagcatcagcacatggttccctccggttcattgaggggcagtcatttctcttttaagtgggaagccccccccacccctagtagtctgtttcacttagggctccatacctcctctccccttctgctactcggctgccagatgtgctccccttcacaaacctttcagagctttttactgcttataggatggagtctaaccccgccttcccctaatattctaaagcccttgacattttgtgcccagtctgtctttgcattttggcatccaaccacagagccccttgcctctagtcaaagggctcctccgaatgagctttggcctttatttgcatctttgcccacattctgcccatctttcaatgctgctgcctccaggaagctctgttggactaatgcagcacccagttgcctctgctgcctccgaacctgaaacaatctggtctggcaactcatttgacacttaatattgttttgtgttgtttaacttgtagatgtgtctgtctccctaactagattgtaagttcactgaggtcaacagcatgccttctgaactgcttcgtattcccctctgaactgtttcatattcccccacagcattccacagggcctaggttgtatgctgtgcaaagatctgggactgaaatgctattatctttctaactgttaataggaatggaagaaattagtttccccaaaaaggaataaaatgattaactagagagatttttaataggatctgtgctacgttaggattaatatataggttgagtatcccttatcctaaatgcttgggaccagaagtgtttcggattttggaatatttgcatatacataatgagatgtctggggggtgagactcaagtctaaacatgaaattcatttgtttcatatacaccttattcacatagcctgaaggtaattttatacagtatttttaataattttgtgcatgaaacaaagttcctcttaagtacttatgtgtggaatttccacttgtggtgtcatgttggtgctcagaaagcttcagatttggaagccttttggattttgcgtttttcagttaaggatgtttaacctttactttaaatcgggttacttgaatgaatcagggaattttagtttgttgtaattatttttttgtttgtgtaattttgctggcaaacagtctatagtgaaaattttgacctagaccccttcaagatgaaagtaaataaatgcatgttatttaaaatttgctgttgttgctatttagcaccctagatgcctgtttacttttttactttgttgttcttataactttttctctaagtaatttcttggatccgtattcgcactgttacaattgtgttcttgaacatacttctaatcttttttagccattatgataatatattttgttttcttgaccctttctgtagtttgttaggttgatggcttccactggaattttaggtttgacctcccaaaggtggatccacctgtatgggaaagatttgttttcccttctccatcccctcccagtccctctgcgttctggccttgggtgtatgaaattctggccttgaacacacctagcagtcctggcccatgtccgtttcccagttaactcttttgtgcccgatctatatgtggcatgttccgccacagctgtgggtggaatcatgcttgtgcccccatataaccttttccttcttagcatttttttcttttcttactcctgagttaaacgtgtagcagaagaggtgtaaagacacagggccagcatgaatagtgctccctttttaaaatgtggaaaccggcttggagaagttaagtgacttatccaaggctgtacatccagtaaggagaaaaactggccttgtgacatagccccagggatgtgctgtgccccgtgatggccccatatgttggtgttgggagttcagtggctcatcaagtgcctgtagctcttaaaggaaaggagttgataaaatgaagcaacctggggcgcttactccaggggccatttctaatctgatttctgtaagtagtggatttttgagagtgggttcttgtatttcctcctggtctgctgtgttcatgggtatttttctggagagatggactctacatcccaaaactggtgaagatcccctgatagaggtgccgctaatgcccctccccatgcagggattgtactggagaagctgtgtctgtggcctgcacccctctggaagctccagtgagtgtcctggggacacattaggaaagtcagatgtgatctaccctcacacccgccagtctcaaacggctttttttccttcttaaaagtaagcaaggaataaactttaaaaatagcaaagggtcagaagttcctttttttttcaagcttttattataggaaatgttacatgtagactccaatagatagaacatgttatgtacacaccgtccctccatatactcaccatcacccaaaatagttgtcaacacctggccccgcttgtttcacttacacccccatgccaccctcatgttattttgaagcaaagccagccatatcatttccctgcccgtaaatatttctaaaatatctataaaagcttctttttaaaaaacatgatctcaaggctgttcccacaaatgttaagctagtgatgtcccctcccaaggggcaaccccacactccctgagagatggtgtatgtgtttcactgctcatgcactggcagccacgtctagaggctgggtctggggtggagcccaagtggggtgggggaccgagcgggcgaggccatggctttgcgctggccgggcaatcatgatgatctcggatcccgcgtgggcgctgtgatggtatcggctttgccccgggcgggaaccacaagatcaaaggcgccgcgcaccggggtgcttcaaagccagtggagcagcccggattgatgcccagaatgagagctctctgctgatgtaatcgtagcctgtgagacaggttctttttttaaatttaaacaaagacaccccttgtttgtttagtgaggtgaagcatgtgttgcagagggcacgcagcatctggagggctccactctggcctggtgggtccatggtagggcaggaatgctgcaagtgactagaattttcaggcgggcttgtagatcttccataaaagacaacctgtttctgttaagagtaatttttttctcccttttttagtatagtcaggcttgttctcaagtgactttcctgaaatactgaaagtgctttcctctggtggggttgtcaggctttggaacacacctggtgagccagctaggaattcagatcaaaaagtaggtaagcagccagggcatggtggctcacgcctgtcatctcagtgctttgggaggttgagaggattgcttgagctcaggagttcaaaccagctggggcaacatagtgagaccctgtctcttaaaaaaatttagctggctgtggtgatgtgtgcctgtagtcctagctacttgggaggctaaggtgggaggatcgcttgagcccataagttcgagactacagtgaactatgattgcatcacagtactccagcctgggcaacagagcaaggccttgtctctaaaaaataataataataataatttttaaaaagtaggcaagagggctgactttggtcagtcattccttgggtctagaaaggaagctcatctgtcccttccctagagtatgtgagaggcttgcccaaggctggtagtcagatcccatcctgttggaaggagagaggggtctccaagaatatggctgagtgccaggatcaccaccacccctagcctgaatattctcccagtctctgtaaaaatcatagacatgtggctgatttttctggggtattcccagttaagatggtatccctgcctttagtagttgatcagtacacaaatcagtgaaaccctgtaccatacatacctccatgagtgaaatcgtggtcatattctgttttcttgcttagcaaatcttgctgacagatagatgaagaagcctgccaaacggagtcagcttgttggatgctgaggtccttcccaagatcttccctacatcagaattcagggtcagtggggtctgaggcactactcaacttaagtcatagtgactaaagtccacttcagcatcttacagatgtcccaaccaaacccagcatgtgtaaaaccagatttctcttctctccacaaacctgtttctgttaggttcttttgttactccagctaaaaagctggtgtcattctaagctgtttatcctcaatgaggtgtccccttctctaaccccatgatgcctctacccatgcacattgaattgtctgtaagttactggaaggcaagactggaagggtttttccttcccttttaaactacaaaccaggtttcccccatcttctgtaaaagcaccccccaatattgtgaatttcaagcatgcaggaaaagtgagagttttgcagtcgacacccatatacccactatctatattccaccgttaacatttcactgtatttgctttcttacattttttatctatctgtgcatgtgatggggttttttgagacaaggtttgcccaggctggagttcagtggagcaatcatgaatcactacagcctcaacttcctgaactcaggtgattctcctacctcgtgatgggtttttgatatttgaaaatcaagcacatgggggctgagatgttataatggatgtgacagagtatgtaaggttccctttttaatttggtttctatcacttttagatccaggtctccccttctctccctatctactgcctccccgctaaccaacccctaccccatcccctggctgggaatagccctagagatcttgcgtctttgttcagacactcaagggagaacccaggaagttgcacctggaggaccacctggggcatggagtttgctatggagaccctgttgtgtttgaatgacttgccctctcacatttcctaaagcctactgcccttccttcatcttgtccctctctttgccttctagtggtctggccttgtggctacagtgagcatgtgcacattctgttcagagactgcagttttttgtgcaatggggtggaggtgctgctgcagagcatggagcaagccagctgggtgggacttctggtgggttttaaattgatttgaagaaaaatctctaaacagtattttgtttctttgattgattgatttttttaaagagatgggggggtctctctatgttacctaggcagacctcgaactcctggggtcaagtgatcctgccacctcatcagtctccccagtagctgggattatacacacatcaccctgcctggctttttttttttttttaattttattttttaaagtcaataaaataggccaggcatggtggcgcacacctgtaatcccagcactttcggaagctgaggtgggcggatcgcctgaggtcaggagttcgagaccagcctggccagtgaaaccccatctctactaaaaatacagaaattagctgggcatgggcatgcctgtaatcccagctactcgggaggctgaggcaggagaatcgcttgaacctgggaggcggaggttacagtgagccaagattgcaccactgcactccagcttgggcaatgagcgaaactccatctcaaaaaaaaaaaaaaaagaaaagaaaaggtgaataaaacaagtggctgggcgcggtagctcacacctgtaattccaatactttgggaggctgaggcgggaggatcacttgaggtcaggagtttgagaccagcctggtcaacatggtgaaaccctgtctctactaaaaatacaaaaattagctgggtgtgggcacatgcctgtagtcccagctactcaagaggctgaggtgggagaatcacttgaacctgggaggcagaggttgcagtgagctgagatcatttcactgcaacagagtgagacttcatctcaaaaaaaaaaaaaagtgaataaaacaagttacttttcttgagattatcaatgtaaacttgagttttggctgagtaggggcattccattggacttggcaaagtcagcttatctgaaatgttaacgctttcatagaaaggctttagcttttcttgtaaacctgctcaaagcaccgggcgtggtggctcacgcctgtaatcccagcactttgggaggccaaggcaggcgaatcacaaggtcaggagattgagaccatcctggctaacacagtgaaaccctgtctctaccaaaacaaacaaacaaacaaaaaaaacctgctcaaaggatccgggaagcccagaaaaatttgatttatatattaaatgagcatgttttgcaaagttaagatgagctacaacttgttgcacttagaatggctttatatgaactattttcttttgctttgctctgtatcccctccaaaacaaattaatatgtgattctgtgtgtgtttgtatgtgtgtgtaaggtcttttagagtagaagcagcattcatcatcttcgctgttgtgaacaggagctggacaggtctacaagctaacctgattcttagaacagactagattcacagaatagataagctctttatcacatggcagcatattttaattccagcctgtggcttccctccttacgggagctcagatagatttctcttttactgtgtgtgtatgtgtgtctatatgtgtgcatgcatgagtgtgcatctttagaagcatgatctgactttgcattgggctcctatggcttccaggatgccaagagctgtgactttagctacctgggtagtggatctgctgactgtgccttttgtgccagtgttgtgcctgttgtattttgctgtagctatagaaggcagctgcacaggctttaaataatgaagtcaagaccaccatctccagtttgattttgtttagagaccatttttggtacagtttagagccagtggataattgcaagttgattagtgtctcccaaccttctcttttggtctgtatttaatttttgcccaatcttttttaaattttatttttaaagtttttaagcccatagaaaagttgaatgaatagttagttgtgtgtggcaaaatgttaacagttgcttgatttgtgaattctctcttacatacacttagttttgattttttttacccgcgtttttactcactttttaaaaccacctttttaggccagactatttgaaagttgccaacataatggcatttcacaccttagtactccaacatatatacatctgctgagaccaaggatgtactcctaactgctgtgccattgtcacaccgaagaacttgacatatttaaatttctctgattgttccagaaatgtctttttttttttttttttttttttgacggagtcttgctctgtcactcaggctggagtgcagtggcacaatcttggctcactgcagcctccacctcccgggtttaagcaattctcctgcctcagcctcccgagtagctgggattacaggcatacgccaccaaacccggctaatttttttttttatttttagtagagacggggtttcaccgtgttagccagggtggtctcgatctcctgacctcatgatccgcccgcctcggcctcccaaagtgctgggattacaggcgtgagccaccgcgcccggcccagaaatgtcttttatagatggctttaaaaaatccaggacccatgcaaggttcccataaggtatttaaacttttaaaatatttatactgaatagatgcacaggtcctataatgctaacaagaggcaaaagacaaggaaagatttctctcacaattctactaccacagtttcaaaccaatttctttttcatctctctgttctttaaaaatgaagctttggacagattttctttagttcactttcctaaccatccatgagacaaaaaaagaacactgatcaagactgtggtgctgtttgactgcataagcacaaattgtggtctttgaaagttcttgctgagagatttggagttttattaagaataccaggaagccagcggcctttgagtaatgtttgaaacaagagggaagaaatcaactattgcttttgtttgttcaaaagctgactttattgatgatataacagtgtctgtaggtcttgggattcctttttccttattgtagacgtggtttctccaccttggcactgatgccatttggaactggataatttttttgttgtggctcctgtcctgtgcgttgtaggatatcgagccacatcccaggactctacccacaggacgccagtagcaaaacctccttcccagttatgacaactagaaatgtctccagacactgccagatgtcccctggttaggggcagggaggggcaaagttgacctcagttgagaactactgttctagaaattcttcaggactaacttaaattgagattgactgtgttactgataaatttctgcggagggacattttcttttataataagccccatcccaatctgaaaatccagaagtgtctagatgtccactggccaagggattgaaatcagttggcagatgacaactgagtgtgtgccttttcacgattttcacactttagcagaagccttgttatctgatactgttgggacctgtaggtggttgggtaattgaaaaaggtcagttaaattgaagcagggaatgatttaaaaagaatcatcttaagttttaattaaagcttataaaagggattcaagctcaggcctttgtgaataggaccacagatatgcactccttacattaacctcagccttgatgtatcgtttaaaacatttctctcagtttgagaaaaaatagaaataaaaaacatttaaaaagaaaaaatgaaaatgtacatttctgatgggttttttatttgtttgttttttcaaagcagaacaaatacgtataaacacttgtaaagctatcaggaactatctagaattttgcttttttttgtcttccaaagttgcacttagctctcaggtgcttttttttggtttttgttttttttgtagttatttgccttcatttagtctttctatccaaagtatattcaacttattttcatagaataaaatagtatattttgcattgtttaatattaaaatcagttacataattataggaggtgagtctgcataaacagatctagaaacacatatagctcagctggtgggagcagtggtgtgtggaggtactagagagtagtttcccagccaggagtctgcagtgcatgcaggctgaagttataggtctgctaatagcccctgccatattctgaaattcatggaaagggccccagaggatggttccgatttgagagttggaagattgggttcaagccccggttctgttgctttctccatggttttgggacaagcccatcagtaggcacaagcctcaggttgcttatctgtcaaatgggaatgatagtaatgcttgtcttgactacggagcaggttatcttgcaggttacacacaggccacataacaggaaatgcctttataaatgttccatggcgcactggtatgttattaatgagctggttatgctgagcctgagatgtgcacttctgagaatgtgttggctatcctttgctctttgagcacagagcacttgagcctcacagtaagagatttaggtcagaagaggaatggagggggccttgctcaatgcaaatttatacccactcttgcagaaacagctttgggctcctgccatgctgaaggtggaggcacatcacatggctgggtctttgtcataggttttgcttgagtggagattactggcttctcagtgataaacccagtgagcaggcagggggtgagaataccaagggtttggccagagtataacaggcagccaaggttctcattacaagtcctttacccatgctttgatgtgtatacaaagtgagtgacatcgtgaagattgtgccaccctggaggaaaagaagtagtcatttcagtgcaacactttagggtcttctggaaagtaagaaattatatttatttttgccagtatgcctcttttgttcttccagtgattcgtcagcaggttgactaaaattagagccgtctgctagtcttgtcccatctaatggttagataaatcttgcactgatgttcataccttgaaggacccttttttgtggaacttcatgtgttagagaaactgaacctgtgtaaaatggagcagatccaattgctctttgtaaccttgctccctgggcccccaaagaagctagaatctcccagttttggccccgtaggtgaagatgttactttgggagtacttgtgtaacctgaagaagactgaaagtatatagcagttctcatgagggaaaccctgggattattggcctaagtctctcttcagtgcagcagaaattctgctgttagaccggcattactgtcttgacaaaaggggaaacaaagaggctactacattgttagggagccccatccatctgtccacccatctgtccatctgtccacacacccatctgtccacctacccatccgtctgtccatctgtgcaacaatgcaaggtactgggaatattgcagtggaaaagacaaaaacccctgccctgtggagccaacattgtactaggcaaaccagatcctagcacattgtcaccctagaatcaggaggactcttcctgcccagttccactgggctagacatgtaaagagaatatgtgagtaatagctaaactttggtcttactcagctaaactttggtcaaatggcaaaatacaggtgaggttcctatggacagagaaggcagatggcataatggggatatgctgagctcagtgatgcatcactgtagacagcttgagaactctaggcatgggccagcttgggacagaggccatggaagagacaggtgtagtgcgtggcacctgtagctgaggcttagatgataaccttactctgctctagcatggagaggacccgttcagccacacctgtggtcatcattgagtgcctgtttgtaaccaaggttgaaaggattgaagaagaggtctgtgtgataagtgggaggtggaagagctgatggcttatcttagctggggaggctgttctgtctcctggccttggtttcctcacctgtaaaataaggccggtatctcaaaggtcacccaggttaaaaaaaaaaatcttaactttgttgagtaagaatgtaactggttgcctctttgatctttgatcagtgatccgcatgagtggagagaacctgacttttcctggtgcctgctgcctttggagtgagtgcaaaatgtccattttgctgatgacaggctccctgttggcatgtacagagaatctcaggcagtgtgagagtgtagtagccacctagcaacattgggtctttgtgcgcatgtccttgtgatctatcaccatgctgctgctcatcttgatctaagatgcattgccagtctgccctgcattgactcagctgagaggcaaaactgggcagaaaagtgggcttctgcaactggaaccccaaaagcctgggcagagctgacccgtattgccttgaatccttgtcttgggtgttactggccatggttggctctccttaagaaccgtcacagaagaaagtcaccaaatgtctgtctgcccatcaggagctctgcacttgatctcagctaaaaggctgagaagagattcatcaggagctctgtagccttcttgataccagcagtgaatctttaatacatgtcttctctaagagatactgtctgttctctctgatctttcccatgcccccttcctctcccttcttctaccttaatgaaagagcaaaacggctaattatatggaaacaaagattgccaaggtttgtattaggatgaagtgtgtgttccacctatgatagtggccaaatcttccaaagtacatcatctgacattttagaatacagacttccctttcatagcaaacctgtattttaatagcttgtggttttaaaaatatcatctaaactcatgaactaacgcattcttctcaattatatcccaactctaccatcatcttctctttcttctccttaacttctctggaaattattggaatctgcttttaaacactggggggattgtatattatagttgtttaaaaatgaatcaatttaagtttgagcaatgtggtaattcaaagcagttttaggtgttattgggattttttataaagagcattcctgagcctgaatgaagcagtcagttttcctgatgagccatgagcccattgcattaatgtttgagtctcctggtgctcatgataacgattaaggagttaatgttacctctgccatgtttaaacattaaccaaagggcttcctctgctattatctgttatcaacaattacttggaacattttctggcagtggagctttgtttttcctccgaggagatgctagaacaggatgagaatagacattaggccacatcaaaggaagattcttgattatgtccaaagaaactctggccttgtgggtacagagagtttgcctccttaatattttgtaaactcctatcacacccccacccccaccccaccccccccacacacacacacacacactcactctctctctctctctctctctctctcccctccctcctccctcctccccctccccctcatctgggtctgaggaagagggctgcagtgattatttcattgtatcatggtgagtggtacctcttttcttatttgggatactcattagagttgctcggtggagatggaatgatggtggggtgcagttaaacatggctgagtgctttctgcttaaggacctgatgtattaatgctctccaggtcattcatatttgggggaaggaacaaagagggtactgctctactgcagatgtgttcatttgcttattaacaaaaggctgggtgacccagaaacttaaaccctgagaacaaaagtactttccagcttccaaatgggaagatcttggagactcttgagtggctcctctggagtgctttctttaccacctagctgtttggagctgtcgtgcctaatagcttctcagcctagagggccccataaaattttagtctgtttctgtatagagtgctttggagtggccgtttctctctgcctcttatttactctcaaataccctttggaaaaagagctgatgaggtgcattgagacttggcatcaaaagccattcattgatagccatcgctcaactctcttggacttaaattttgttaaacaacaatcacaaaaagtcttaaagaattacccctgtttcccctgaatgttgaagtaagaaagaaaagaattactcctgtaatgcaagaagacatactcattaaaatctaaacagcgaaaaagtatatcgattaggttgggcgcggtggctcattcctgtaatcccagcattttgggaggctgaggcaggcagatcacttggggtcaggagttcgagaccagcctggccaacgtggtgaaaccccgtctctactaaaagtacaaatattagccaggtgtggtggcagatgcctgtagtctgagctactccagaggctgaagcacaagaatctcttgaacctgggagatggaggctgcagtgagccgagatagtgccactgcactctagcctgggtgacagagcaagactctgtctcaaaaaaaaaaaaaaaaaaaaagtatattgattaaaaaggggaaaccctcccatcctgttcttcctgtagatatcactgggaccagctgggtttccagtttttttttctgtgcatttctctatactcacacatggttttgcataaatgggattatcctatacacctgttacttgacttgctggcccaggacttctctgaatgtagggtatgctagatgcacgataacacagccccatcatggcttgtaattcaggcatttagcgtaagctgctgggtttcacttttcttctggaagcttcaggcattgccctgctttctggatgtgctatggttctggattcttcctttctttttctcttaatagggcttgtctaggatggaatttcaaaataacttgattctttccatctgagacacaagcacacaaaccctttagcagaaggtttttaaggttgcctgtgtacctgccctttgcccctagaggtcccactgtgagtgccccagtcacatgatccactctggccttatgggggcagcccaccctggcgcccgtgtggtgaagcctactcgttgtcaggtttccagtcattcctctctgcccttagccctgttgttctgtggctttgctttctgggtgctctgcccatgtcctcagttcatttctctcattccgggttctttgcctgaaatatcctcactaggctccactctttggggtcaagactgctgtctttgtgcacttggaggctagcctgtctctgttgaagtaatgtgtgggtagggtgcccacaccaacatccctgacacagatctggccagccaccttggatcagcctgctgccttctcccatctcctcttagatttgttcagttccaccctttattggctgcagaaaatgattctctacaattctttcactgtggtttatgatagaatccattttcttaaatctgatgtaggatcactttccccagcagcaaggtaattctcttagggtcttcaaaatggctcccctacccgaattcccgaccatcccactaactcagagggtggggagaggtgagtagatgatgcatttgcttcaagaagtgttgcctgtacttcccatccatcaccaccagggcatattgaacccctctggcaggctcttctggtgccctctgtgatgtgagaggagttcgggggtgcagagtgaacatagtcaaggtaatttaggaagctaagctctccatgttctccttggcacaggtttctctgagtcagttggtcactccctcccaaccgccatagttttgtttcaccttggggcttttattgtgaatctccacttacggtgctcctaacatcttgcaaaggtctttcagccataggtccctgatcaggaaaaatggtctcctctctgcactccagttttattctcctaatcctctctggctgagagtcctgacctgactcagccacgccccagagccagagccctggccacttttccagcttggtccatctctcatctctgcctattcagcctaggtgtcgtgaccatcatgcccacccagcatgccaccctgtgtggtctcctgccttgacaaggtgtgtcccttgccctggagtacatcagcaggcaaccctgactcctttcagctcctagtgccccggtacctctcctgggatcctgaggtccactctgctggatgccctggcagagcagcaggctcctgggagcacctgggattgtggcccctgcttcctgggcccaggaagtgccctgagtagctacttggtggtgggtgggttacttctgatccgtttatatttgctgtactccagcccaccttggttttttcatccacagagtagaaataaattaagtggctctaagaagtagtgattctttttttaaggttggatttctgtgcttttcttaaccatggctttcatagttttgctaatagacaaaaacagtccctcgactgcctctgagagtagagctgaaataaaaattctaggcgtcttctacagtagctggagtcctgcactgtccaaggagtctcagaatgtagtaggaggggaagaagctggggattatatatctacctggaccatggaacgggatcaaagaagggcattgagcggccatcccaaagccagggcttgtaacttaacatgacacctcattcatctgagctgctactgcatacaggtttaggattctttttaaattgtgcaaatgagtctctatcttttaaactcttagctgtcatgccctggctggtgctgttattataaaattgagactggaggccatacatttgaagacgaagacagtaatccgctgccaacctacttctctcttataatatatatatatatatatatatatatatatatatatatatatttttttttttttttttttttttaacaaaaggaaagaaaaaaactcatgccagacttgtttgtctgagatttatcactgtagggatcccagagacccccatggaagctggctttagtggtggctgcggctggggactggacagaacaggtcagtgtgagcttgaactagactgcgcctgcctcctggtgcacgtactgtgtttgggcatgtgttggctcttaaaatgctgttcatccatcaacatactgaccccttttgcaagtttcattgttctattattgtgactataaaagtggcacttgttacaaaaccagtttctgtgatctagaaccgtgttctcaaacttgcatctatcagaatcatctgccccacctctagagtgtctgatcagtagctttggggtggggcctgagaatctgcatttctaacaagttcccagatgctgctgctactgcagctgacctggcaaccaccctttgagaaccactgatctagaaggtacaaggaaatgaacatcgtcttcagtcttaccactcgggagagaaccactgttaacattttagggtataatgaatatattcatacatatgtggacatatttttaaaaacaatgatagttttgtgctgtacatagcgttgctttttaaaaaaacaaccttctttcttttggaatagttttagatttgtggaaaagttgcaaagatagaacagagggctcctgtatacccagcacccagtttctcttactgttaatatcttacactattatggaacatttgtcagaacaaaggagccaacattgatacattactgttaactccacattgttactgcttttattgaaaatacatgaatgtattttcataggattcaaatatcagaaatacataatgacagagtgcctcttcactcctaccatcccacttcctatatatttcagagtattttttatatatttatatacacatgtaattatgcacacacacccatccatcttattttaagacatgcttttttcatttaaatatgtcttgaaagcttttttttttcagtatacctagatctgcaccattatttttaatggacaacacattgttttacacccttttaaatatatcttatctattttaatctagcagattaaaggtgaggtctggcacacctcccttttatcttaaagtggaggttagagattatttgccctcctttgtggagtacttagcgtattctaggcactgccaagcacttagcgtgtattatctaacctagttatcaaaacagtcttactcataggtatcattatccctgttaacagatgaggaaactgagggtcagggaggttaagtgagcaaaaacttttgacgactttctagctgaagcaggctgtctctggtactttgggtgacatgagctgttcagcttagggtgaacattgcttggtttatggagtcttcctgagtgccacacctagtgccagaatatgaaggtgaagggtatgcttagggaactcacagtcttatagctgaggggagatgtatatataaaacaaatgattatgtgataagtattacattagagtttgtaagatgtaagatgggtttcggataccttaaaaaatccactagaagtaaggcatgtgcttggaaccatggcagaacagatggaagtatagcatcagatttggcaatcagacccgagttctaattctgaatattactgtttagctgtgtgactctagataaggcatttaacctctctgagtttttggtattaatatctcaaaataggccaggcacggtggctcatgcctgtaatcccagcactttgggaggccaaggctagcagatcgcttgaggccaggagtttgagaccagcctggccaacatggcaaaactccgtctttactaataataccaaaattagctgggatagtggtatgtgcctgtaatcccagctacttgggaggctgaggcaggataatctcttgaatttgggaggcggaggtagcagtgagccaagattgtgccactgcactccagcctgggcaacagagtgaggctctatctcaaaaaaaaaaaaaaaacaaaacctcaaaatatacttcatatgtttgttagggttaagattaaataaatacatataagaagtagctattgttgtgtttagtaaatatgtacatataatgtgtttagtatatttagcataaacgtataatctctgccacatcagttgctgagttgaaacctgcctttaaaagtccttggaaagttccggatagaaacaaggacagaacgaaatcccccggtcttttatctctaagaccaaatcctgaagccctccctgaaatcccctgtgccctcagtctttgcatcctcagagcattctcttaatgggcctcactcccatttacatgttatcctgtttgtgccgtctctcctctgcaagtactgtttctcggagggcagaatctgtgcctttcattcttgtgtcccctgcaatttaatggaagcacattaaatattagttgtagaaccagatgctgtagaaagggttcacatcctacaccccaagtcaggtggagcttacatgttatggtttttgaagagtttttttcacctcttccaaccatccttcccccactggttttttagacgttagcctttgacacccaaacttgagttttaacatagaagggccattgagcattttattcaaaaagatttttaatgaattatatcttgatatatgagtagtcctcattatgaattaacttaatcctcaggtctttcactgtgaggaaagatttatgttgatattttcccccaacttagaaaagcagaacaaaacctcagcaggcctatgtcttgtgtagccagggcaattcttaccagactgccacaggttagagaaaatgctgcccattcttttcctttcctgctcgtgcttagaggagggagcattctggcagggattctgggccagtgaaattggaataatactgtaaagaagttttggttgaagacaaggctaaatgaattaagggaaaggctagtttcttaataagtttctgagttcgtcctagaaagattggtagttaaaccatgttccatgtcaacctgaactgtctaaatagtaatcttgagaggtatggcagtgttattttttttctccttctggaaaatcagctaaacttgttagagtatgtgaaaatctactctcctagatttgaagagcaggattctttttggagggcagttacagagccacactaggtttctgctttttttttttttttttcttaaataggagattgctccctcttaagagagccaacgatttagaaaacttaatcacaggttcttcttccattcacacttaatctggtcattcagaggctcttgccctccccttcagaggctgcagcgcctgacctggggccacggaggtcttcctcctcaaccttcagaaggttcaaagggcaggagtgagtctgattctttggatagggggttgggttggatcttttaaaattaatttctgggtgtgaactgtaaaagagacgaaccagtagggatttactctcctccgtaatttactattgcagccagaagcctgatggtttcagcacccccacccagaaaaaaatttataaaatgaccaaaatgttacagaaatttatttcatggaggttgttcattttatggacagttgttccattttaagcactttgatcaccctcctgattccctttttttttcctccccctttttggacgtcagttctctggcatgtttagtgacagaagcaaaagggctgtaggaaatctttcttcatgtaaataagtacctatgtctctcctcatacttttattttcctctggcattaaaatgagaagagtagggtaggggacttggaaatcctatcactgcaaaaatggttggcttagatgccggtggtggtggtggcagccagggagggaaatcaagagtcctttgcatgtgcctgggtgcacctgcttgtttattagatgcgtggctgtaagtcatctggagtagtgcaaatttgtatttttattgatttgaattcagagaaggtttttggtcttaatttaactaatttatttatttttcattttagaaattcaatttcagcttcaccctaattgtcactactaaaatcctacatatgcaattctaagcttaccaaactgataaaataagatgactttattacttttattttttaaaatttctcgttttccttttctcttttccacttggctgaggacaaatatagataaaatcttggcctattgaagagccagtaaaatgttgttttatttttgtttctaacctgggatgttttatatctgcaaaatgtggtgaagacagacccattcattaaaaacagactgctcaactgggcaccatggctcacacctgtaatccgagcactttgggaggctgaggcgggtgggtcacttgaggcccaaagtcctcaagtgaccagcatggtgaaagcctgtctctactaaaaatacaaaaattagctgggcgtggtggcgcatgcctgtaatcccagctactcgggaggctgaggtgggagaatctcttgaacccgggaggtggaaggggaggctgaggtgggagaatctcttgaacccgggaggcggaggtcgcagtgagcagagatcgtgccattgcactccagcctgggcaacaagagctaaactctgtctcaaaaacaaaacaacaacaacaacaacaaaaacaaacacaaaccagactgcataagtcttcgacttctgaggtttagtctggaagaaatttctggtgccattttagttttgtcctgcacatgggatgtggttctttgatgcagtttcaggcctgaagccaaatgtgtacctctagcccggtgaacctctcacctgttttaggaaataattttgagcaaatcatactttctttgaggatctgaagtttctcaacaaagcttgtctgaagctatgtgatgtgacgcgatgccgatgcagagagcctggatgaggctgcacagatgtgcccaactgcctgatagcctgacttctctgaaaacctactaaaaccaacaggcggactgttctttttttggacaagaaaaaagacctggccctttcatatagcacatcaagccttggtagcaaccagaaactaagtgacaaatgcaagcttttagcccctttccttcttgtccctagaccttcatagttgtagcttgtcagtagaaagaactttggcctgggagttgggagactacctgggctccagattagctgagtgacctcgggcaagtctcttagtgtatcccaagatctttctccagagcgagagagtggaatttgattctctagcggtctcttaccctggaatcctgtatgattcttaggggtccgtgctacgtctgaggttagagatctcagatgtgaaagagactgtttgaggtgtccacttaagagctgcaaactctattgacccttgtgtctttcaactggaaaaatgagagcagcttctactcaaattaagaggtgccctcagattcccctatttagattctgtgaaccagtgataagtctcctcttctgtgtgattggtgttgcccttttgggatgtagacattttggactaaggatttagagatttttttaccgagacaggattgtatgcgtactaagatgtccttaaagctggtactttccccttttatcactaatggctgctatttccagagctgtgggctttatctgaccatcttgcaggtatgttgaaagatttgactagcacttaaaaggtatgttcagaaaatgctattttaagtgtttcttctttaccctatttcccccttgttgaacagtgcaaaactaccaggttttatgttccactgggcagctgctgctggtctgatgtttttctctctgtccctcctcctccttctgtctcccctcccccgggggtcctcccccagtgcctccccctgccccattcttgctccggtctgaagggagctgtacctttgtggttcttctgcagctgctggactttgatggggacatgcttgctgcctctacacttgcttcccttagcaaccgatcctttgacgatgacctcttgctgtttgcctgttgtctctcatgttggattatagatgagagatttaccaggctgggggtagaggcctgctgttagcacatttcttttagggttcccagcgtccctcagcctgtgttttctctctctaaaatatgaggtttggagagggtgcatgtgtgtttatgtgtggcggggatattagtgccgaatcaaacagttttaagttcatagggttgtcctagttgtgagctaattttgaagtagatgctgtggtggttactgaagctacttgatttacttctcatttttattataatgtgattaacacacatggggggggaggggtgccatttgttcctctttacactttccaagtgtttgtgtgttggcactaaacttgtttcctggtgtaatctgagctctgagaattgccaaattacctaaatctccacacattttaacacatttattttctcccaaagcattaagtttttgttttatttaaagtagcagtattcctggacatgtggctcttattttgcatggacagcttatgatgttccgtgtgtaactagtttgtgcatttctgtttagctcggtggatttgccttggacaaattagggacaaggacattgtgggacagcaagaattccaaaagaaccccggattaaggccaaaaaggaaaaaaaaaaaagccatttttaaagctacccaaagaggagagtctaaaataaaattagcaatcatttttataaaaagatacaagaaaatagatatttacacactgctggtggggagggtggcttgtagcagtacaatgtatcaagagtcttaaaaatactcataccccggctaggtgcagtggctcacacctgtaatcccagcactttgttttgtttgattatatagtctttgggggaacattttttttttctaagtcttcacagtttagaggagagctacttaaagatttcattatataaacttactactttggctgagtgcagtggctcacacctgtaatcctagcactttgggaggctgaggcgggcggatcacgaggtcaggagattgagaccatcctggctaacatggtgaaaccccgtctctactgaaaatatgaaaaatgccgggtgcggtggctcacgcctgtaatcccagcactctgggaggccgaggcaggtggatcatttgagctcaggagttcgagaccagcctggccaacatggcgaaaccctgtctctactaaaaatataaaaattagccgggcgtggtggcgcacgcctgtagtcccagctactcaggaggctgaggaaggagaatcacttgaacccaggaggcagaggttgcagtgagccaagattgtgccattgcactccagcctaggtgacaaagcgagactccatctcaaaaaaaaaaaaaaaaaaagattagcgggggtatggtggcacacacctgtagtcccagctactctggaggctgaggcaggagaattgcttgaactcaagaggtggaggttgcagtgagtcaagatcgtgccactgcaccccagcctgggcaacagagcgagactccgtctccaaataaataaataaataaataaataaataaataaataataataatactcatactccttgactcaacagtttttcttctaggagtttatccttaaaaaaagtttaagatgggctgcgtgcagtggcttatgcctgtaatcccagcactttgggaggctgaggtgggtggatcacttgagctcaagagctcaagaccagctagcaacagaatgagaccctgtctcaaaaaaaaaaaaaaagtcaaagatgtgtatctcaagacttacaggtaaggatgttcactaacatgttattcgtaatagaaaattactaacaatatctaacaataaagggctagctaaatgataatatttttgttcttatagtagagtactgtgcagacatctagattgtttgaggatacttaatgtcaggggaaaatgctcataagtgaaaaaagcagaatattaagcaatgtgtcatatgatcgtaatttaaaaagaaggaccgggcacggtggctcacacctgtaatcccagcacttggagaggccaaggagggtggatggcttgagcccaggagttcaagaccagcctgggcaacatggcaaaacccgtctctatttttttttttttttcttttttaagacggagtcttgctctgtggccaggctggagtgcagtggtgcgatcttggctcactgcaacctccacctctcgagtttaagcgattcttctgcctcagcctcctgagtagctgagactacaggggggcaccaccacgctgagctaatttttgtacttttagtagagacggggtttcaccatgttggccaggatggtctcgatctcttgacctcgtgatctgcccgcctcggcctcctgaagtgctgggattataggcatgagccactgtgcccggccccatctctatttaaaaaaaaagaattgtgtggcatacacagaaaaagaatgaaattctatccacaatctgtctctttggtaatgggatttttagtgctttcattttcttcatattccaagttcttcagtggtcaggtatcacagattgtgtatccttaatctgaaaatctgaaatttgaaatgcttcaaaatctgaaactgtttgagtgctgacatgctcaaaggcaatgctcattggagcatttcagattttcagattagggatgctcaactggtccgtataatgcaaatatttgaggatctggtcccaagcatttcggataagggacaccccagcctgtagttttataagttgagaaaacttttgttttaattgactcttcaccccccgaaaattattttgagaatattttgtctaaagctaaggacttaatagatgaaccaagacaatgacttttctctgtgtttcttcttgttgttgttagaatgtgtttgtgggtttgtgctttttaaaattaaagcccccttttttctttgtgtgagagatggctttggggtttttaagttgcagtgttatctgaaggaagttatatcgcttagcaggaactcagtacaataatgtgtcatccttctgtaatcatgtaatgatgcctgacttcaaaatgacttactagtatttgggaattggtgtttggactggttgtttatgagaaagtccaggtagaccgtccatttactaaatacggacgaatggcaagggacttgggagctttctgtttgatggtggttgaaatcactagttatggatgccatctttatttggaaatgtttgtaatttgggaagaatgagaagtgttagcagatgatggttctatgaacagtttgtctaggagcatcagagtgggaggagggtgttctggggactggggagtgggtttcatttgtgtttggcagtagctggtgatggctgttgatagttgaaagatctatggtctctgttgaggagtacttgaccatgaggttggttgagtgaggaggtgagtagctatgagatcacaacctgacaggccttacgcttcctcagccttcactgtcaacaattgcttgggaaacctgtaagaatggggagaagagaaatatagcagccatatcttgggcaggtattgagagggtagttcaaaatgttggaatatgggtaaaactagaatgctgcacttctattgggctcatcatttgggagagactagtgagggtagagttggttctcttaagttggtttagtcttttaacactttattttgaatcctttaaataagcacatatgggaatgcacaggtagatagaattttcttccactgataacttgctatcagccatgtattactgagtagtatttcattgtgtggatataccacattttatgtatccactcttcagtcagtaggcatttgggttgttttcactctgtttattatgaacaatgctgctatgaatgttcatgtacagcttatggacatgttttcatttctcttgggtatatacttaggagcggaattgctgggtcatatttgccactctgtttcatgtcttgaggaattgccagactgttttccaacatatctataccattttacatttcccatcagtagtgtatgaggattctaatttctccataccctctctaatacttgttattatttatattctttttattatggccatcctatattagcaggtatgaagtgatatctcattgtggttttggtttgcacttccctcatgcctaatgacgttgagcatcttttcatgtacttattggccattcatataccttctttggagaaatgcctgtttagatcatttgtccatttcaattgggttactcattttgttattgaatcataagggtagttacacttttaaagtgttggatcacaaagagatttgccatctgagaagttagaatcaaacatttaaaattcatttaagaatggttaaaaacacattacatgttaacaaaaataacttttttttttgagatggagtattgctctgtcaccaggttggagtgcagtggcgtgatctcgactcactgcaatctccgcctcctgggtccaagtgattctcctgcctcagcctaccaagtagctgggactacaggcgtgtgccaccacacccagctaatttttgtatttttagtagagacggggtttcaccgtgttggtcaggatggtctcaatctcttgaccttctgatccgcccaccttggcctcccaaagtgctgggattacaggtgtgagccactgcgcctggctacaaataacgttttttatttaaaaaaaaatttttttaaaaaagatgtggtcctgctctgtcgcctagactggagtgcagtggcacaatcatagctccatgcagccttgaattcctgggctcaagtgatcctgctgccttagcctcccaagtagctgggactacaggcatgtgccaccatgcctggctatttaaaaaaaatttttgtagagaccgagtcttgctttgctgcctagggtggtctcgaactcttggcttcaagtgatcctcccaccttggcctcccaaagtgctgggattacaggtgttggcccagcaagcctggcctaaaatatctttttgttttagaaaatatagtgagaaaaatggccttgttttatatatttgcaaatctctttaatgcctggcttagtaagacagttggattcttgcatccacttccgtacctagtctgttgcaatatgctttggttgaagtataactaagaaaatctagccttacacagatatgtagttggaaaagggaggagtattttatagcctgttaagatattagtaattatgagtattctttgatactatatctaaactggacaagaggtagtttctgaaagattagttgcaatgtagaatctgaaaccatgtcaatgaactattcctactgtttcactttgaaatctattggtctctgttgcattttgaatggatcttttactaatgaatgattttgtattatcatctcatgcattggtcatttagaaaatattgattcacttagtcatgtagctcttccaaatactaacatttcattatacagtacttaaaaattcacatttaattaattaattaattatttttgaggtggagtttcgctcctgttgcccaggctggagtgcaatggcgtgatctcggctcactgcaacctctgccttccgggttcaatcaattctcttgcctcaccctcatgagtagctggaattacaggcacgcgccaccacgcccagctaattttgtatttttagtagagacgggtttcaccatgttggtcaggctggtctcgaactcctgacctcaggtgatccatctgcctcggcttcccaaagtgctgggattacaggtgtgagccacagcacccagcctatttatttatttttgagtcagggtctgactctgttgcccaggctggaaggcagtggcatgagctaggctcactgcagcctctacctcctagactcaagtgatccttccacctcagcctccaagtgtctagggctttagctgcatgccactgtgaccagctatatttttttattttttttttatactgatggggtttcaccatgttgcccaggctggtctcaaaactcctgagctcaagcaatctttccaccttgaccccacaaagtgctgggattaagcgtgcaccactgtgcccggccaaaaattcacatttgttcccaacagaaaagtctctaagtatcaggattctgtcagactcatagtgataggtacacatttcccaaaagtttaatttttgcttgagagttcaagttttatcattggcaaaaaatattatcaattgtttccttgaagtgttagtctcatttcattcctttttgagaaaatgcctgccctgcactcatctatataactgtactttaaggtcagttactcgtttaagtaaaaatggtgttccgtgaaaaaagttgactagtttggcttacagctaacaatcacacaagtattttgtcttgaggcaaccactgtgctttggtatgcagcagaagtgctttatgcgtatttaaccatttcgccacgcagaattttttttttaatgtactcaagggttgagatttaataaacttaatagtttttattgcttcatctgcattgcttcatcaacattcttaaggaaacttttatttcaattccaagtatacaatgatcaagagtgcagtttggtgtcactgctgtaattcttgcaacagtttttcccaccactgcttttgtacatgaatcagtgcaaatgtcagcagactgtaaaaggctaataatgtctttgtgttattacaaaaatggttttgccctcacagattacctgaaaaggttgaaggacaaacctccacccaccgccccctgccctgggcttgcagatgggatgagaaccactgggctagacagcatttaatggaaatggggataaaattgttttgaaggtgcttgctgctctgttgtctgagactggtagcataaacttgcatggtgatagcagcaaaatgtgtatagtgttgtgtaccttgttgcgttgttctttccagtctttagcaatatgcaaaatcacaaagcactaaccactgagactcctttgaaaataaactgcttcctcattttcttcttcctttcctttcctttctaacaagaaaagcacctcttcaccacctaccttgcaaatgtgctgtttcccttatttcatgttttgagttttaaaaagacagtggctctttagggccttcctccatatctctgtttctgaggatactccttatacttagaacgcttgactgatgtctagttcaggcccaggccagtggctggcaatgacctcattcttgccatgtaaatccttactgaatggcatgagactccaacttagcagttcatggaattgtaaggtgagcccagtttcccagccaattatgactccatctaaagccgtagctgggccattaatgtattttgcgccttgtcctcttttatatcttgccaaactctgagagtctactgtatagctactggcaacaggcctctgccaaaacagtctatgaatgtatcattttacacctcatttttccttgtttccccctgtgatggcaccttgcctgtgtttctctctcccacatctttctacccacttaaaaaaattattcatttaacttattcctttattgtggtattatagacttttggcttctgtagttatttagtgtgaaagagatactgaagaatgaaaatgctaatatcttcttatagcgcccttcctttttcaaccactagtggttctcctaagggccctcttctgggttgaattgtgtccccccaaatttatatgttgaaaccctaactcccagcacctcagaatgcgaccttttttggagattgagtctttacggaggtaatcaagttcaattaaggtcgtcagggtgggccctaatccaatatgactggtgtccttattaaaaggggaaatctggacatatgcacacacaccaggaacgtgccaagtgaagatggaggcagtgattggggtgatgattccacaagccaagaaacaccaaagactgccagcagcccaccagaagctaggggagaggtgtggaacagattccctcatagcccccataaggaatcaaccctgtcgacatcttgattttggacttctagtctcaactgcaagatgacaaatttcttttttacccagtttatggtagttcgttaaggcagccctgggaaatgaataccaactcaaagctgactgctgtctcccatggccctgtggttctcttgctcaccttggacctttgttctacaggtcacaccacggctggtctcccagggtgacctgtgcgcctgccatgtaaggttcctcctcagagcagtgctctgtgactgctcacgctaatgaagaatgcaaggttgaggactgtgttttctggaaagatggatagagatggtttagggactcagagataggcgactccatgtacctgctcccatcccgtttgcatgtacctcttcccctgtgttgatgagaggtattaaaatcctgctggcctccacttgctcctcttccccgtggagcaaggagcactgagccagcatgggtatatctggctttcttttctccgagtgcattctccatgggaccctcctgcgggttcccagctgaccgctggtttgcaccacacagccaggagaagtggccaagaaaagcgagctgctggatggaatgctcagggccccaaaacattactcttcgtgatagtttggttcttgccaggatgtccttgtaaaacttttatgaagatgttgttgtacttgcattggaggttgaaaattgctgttaaccttgctaagtcccatgtcccccaggaatgtggaacgctatggaaatgctctggccctcccttctggacgggtgctccactgcagcagctgcctgcacagaaagttgagctggctggctggattaagggacatcagctaggcctttgtttaaaaatatttaaaatatgtttgaacctccctttatcaacaaagaacagtttctttcagcagagagaagtttttcatttccatgttttttttttttttttaaccattttgtttggttcttttgtatattagcaactttggaaaagtgttcccattcacagtttgaaagccaagtataaaaggtattgcatcgttattttctattttgcttaagagaaaagagcagtttgcttctattaagaacataatgtttatgaagataatcttctggcttgagttaatttttttctggtgtcgagctttgacagttaaaaagcaagaatgtgtttgcgaatgtatttaaaacatctctggaattaggagtttatgaaggtatattaggtaatgagaatgagctttggaagttacaaagaaataaaagaggttcctgtgtctgagtctgctggtatgagagccaggagtattaacctatggagagtccttgactattaggtcttttgagttaagtttcaggataaggcagcatttttctaaaatccaggttttcccttgcctgcctttgtgatgatcacagtgtgtatcaggtttctgcttaacttcagatcttctttgggtatcttcccagtgttattagaaacctgagatatttccctacttacttgcaggaggagccagcatgttgcataactgcaggggccccattcatcttagagtgtggattagaccagggtgtcaagggccctaggcagcgtgcagtgctatgtgcaggtgctagcagggaaggcatggtaggtgaaggttcctgtttcttgggtgcattaatatggaattacttttcaaaacgtatcctagccatacccttgttattccatgtttttaaaccagatcattcatcttgaggagtactcggccaactctaggtacggcttttcctccagcccctcagccactgcttgacagagttgtgaggccacagcctgtgagaaatcaatctggagaattattagttgtctcttaagttgctttaaaatcgcctggaggccaaccctgaagtttaggaaaagagtgtgcttgtgtttctcctgttgacttctttctcctccaagtgttcttgtccttcagttgactctggagactggaatatgagtaaagaacatgaaagggactttagttaaacattagaacctttcaagtttcagggcttcaactgagcttagtgacatgccatcaacgaccaaggttcccatatatcctgaaaggatatttctctaaggccagttaggcatcaatcattaatcagacactttacaaatggtacttatattaggttgaatcttatgaccttgccatttttgtagatcagaaattgttggatattggcagtttcccatggttttacctggagtactctggagaggccatgtagcattgtgcttcagaatagggacctgggacctgtgggccttgtgctaggctggaattttcaccttggcacttatttgtatgtgacactggacaggtcacccactgccattgactgccattgattgctctgaaaatggggcgattgtggttccacaccatagggttgtttttaagattaaatatgtccatgtatataaagcacctaggacagggcctggcacacggctcactctgtgtgtgttttttttcatgacttcttcattcttaggaccttcacagtttctgccatatctgcgtgccagctgtgtagtcattgtcttggtcagcacaggctgctgtaacaaaataccatggactgtgtggttaaacagacatttatttctcatagttctaggtgctggaagtctgagatcagggtgccagcatggtcgggttctggtgagggccctcttcctggctcacagagctgtcttcttgctgtatcctcctgtggcgaagaaagtgtgagtgagtgagcaagctctctggcatctcttcttagaagggtactaatctcatcatgatggccctgccctcaggaccttatctaatcttaattacctcccaaagaccccacgcatctccaagtgcatattgggggagttagggcttcaaaatatgacttttggggagacccaattcagtccacagcagtcatttatttagtgtttttctttaaaagtgacagtttttaaaacaggaataacttatcttgttgattcttggatgcttttcttgtttttgtatatcatctctgaaattagaatgtcttttttttttgagtcactctgttgaccaggctggagtgcagtccatgaccatggctcaccacagcctctacctcctgggctctagcaatcctcctgagtagctgggactacaggtgtgtgccaccatgcccaactaatttttgtatgttttatagagacagggtttcaccgtgttgcccaggctggccttgaattcctgggctcaagggattctcccaccttgtcctcccacagtgctgggattacaggcgtgagccaccatatgctgggcactgtgggataatatcttaaaatctgtgaaatgtcctggtttaatttttttcttgtccactaaaagatataatggctgatggcatcacaggtttggtggaaaatggtatttttggtgtttttttttttttgttttttttttttgagacaaggtcttgttctgtcgcccaggctggagtacagtggtgcaatcatggctcactgcagctttgacctcctgggctcaaatgatcctcctgcctcaccctctggagtagctgggtctacaggcacgtgccaccacacccagctaattttttaaaatgttttgtagcgatggagtcttggtgtgttgcccaggctggccttgaactcctgggatcactcaagtgatcctccttcaccagccttccaaaatgctgggattatggggatgagccaccatgctgagcccctttaaaatggtagttttttaaaggaaatattatcaagagtttgtgctagttatgtttttccaacccatgttaaaatgaataaatgtctgttgttttaaaaagtcctcctgtgtaccaccttgcagcctctgtggatcagcagtggactcctggcctaccctctgggaaacatgaatgtggtgtatagtttttggatcatgttttgtggagcagcatcctcactcagcatagctgtgctttggttggtctcacgcactgaagtgttacttaaggtttggattatgggaaggacttttactactaaagacgttggaaaaccatatgttttgggaggctgaggtgggaggatcacctgagcccaggagttcaagaccaacctgggcaacatagcgagaccctgtctctattaaaaaaaaaaaaaagagccaggcatggtggctcgtgcctgtggttccagctacttgggaggcctaggtgggatgatcacttgaacccaggaggtccgggctgcagtgagccaggttcacatcactgtactctggcctagatgacagagtgagaccttgtctcaaaagaaaaccacatcagtaagccatcttctcgtttgcctcactaacatcctgttgaggtgtcccacaaaccaaacaggatgtgggggtgcggaggattatcccctctaggagcaagttgccccatctggttgagggagaggtggttctgtcaccagtagagcatgttgagtgctgcagagatggctggcgacggggatgtctggcctggcagatgtcaccttcaaggagggagtgtgctcattgcaggctgctttctgggatgggagtaggctagtaatgtgatgtgtggggccttccctgaaatagaaggcactggacaggcatgtagtatggataaggtagagagggtgatggatagttttggctttccttgtgaggtgggcatgctggtggcatgttttagattttccgaatggcctttgtttccatttccttttttttttttttttttttttttaaagctgcatccttttgcatcgaatgaaaccccatcaagggcatctcctaactcttcttccattctcttgtccagggctggtgttttttgtgtgtttgtgactgacaatgcagcatggagaatttggagaagctagttttgccttttctcctacaggaagagggactcgtctgcaaagaaaggggtctgcctttcagtcctttgaagccacctggtctgacaaagacagtttccctgtccctttttggaccttgagctgagcaaaaaattacttagttgctgaaagcaggtcagtgtagaggacttcctctactcctgctttgacttcatctgcaagagagctgagaactgagtgaggcatttctgcttcttgagacttctcttggtgtggcagggcttcctgtccaggaggggctccattgcctcatgccctgggtataaacagtcccagagggctttggaatcagcctgggtcaattctggaggaaaaataaggcctaataagcatggctcttttcccaaaatgtagccacaggggtctaagcagctgattgtggggtccagggccaccaggagtcttggctggcctagcatatcttgatttgttaagaaggtggatatgaattcagtctagagaagataacgtgcctattgtgcagaatgcagggctttttgttcaaggctgtctccatttggaagtagaatgacaaagcagtgtagatttacacagagcatctctgagtctgttacaacccttaagttttatggtttcgagccaggacagtacttcttacattctgtctttgtcaagggcttttgtagtcctgagattttactgtggtgcactggttatgagatgagactcatagttacaaaattccaaactgaggattatcatctagaaccactccacagttggatccttggcctcactcttcactgtgtcactcacagcacctgtcacaatgcatgtatgttacccagagggtgcccagtaaatttactgaacgagtttctaaacttccaaattgctttctgattggataataatgacagtttttgttttgttttgttttgtttgagacagagtctcgccctgtcgcccaggctggagtgcaatggcatgatcttggctcactgcaacctccgccttccaggttcaagcaattctcctgccccagcctcccaagtagctgggactacaggcacacaccaccatgtccagctaattttttgtatctttagtagagacggggtttcaccatgttggccaggctggtctcaaactcctggccttgtgatccgctcgcctcggcctcccaaagtgccaggattacaggtgtgagccaccacgcccggccaatgactgttctttttgagaccttggacattacactgaatccagtgaagtttcttgagactgtaccgtgattaggggtgggaaataaatgttgtgtgcagttttggatctggagaactttgtgggagtgaagagccaagaaggatgctttgaaaagcataactcttgctgggcgcggtggttcaagcctgtaatcaatcagcactttgggaggccgaggcgggcggatcacaaggtcaggagatcgagaccatcctggctaacacggtgaaaccccgtctctactaaaaatacaaaaaaattagccgggcgttgtggcttgtgcctgtagtcccagctactcgggaggctgaggcaggagaatggcgtgaacccaggaggcagagtttgcagtgagctgagattgcgccactgcatgccagcctgggcaacagagcgagactccgtctcaaaagaaaagcataactcttctcttctgtccacttgttaataacagctaaggttgcaattcatggaacaatgagttttgtcttttctgaaacttagtaaccacttggtctatcaacaactatttgagtagtccactgggcaggcaataaagcagtgatcagtagatttggagatggataaaacagttggttttctctcactcccctcctttaggggagggaaaggtatatgatacagtgattaagagcattaactgaggtggcgggcggtgttagagtgtctttttgaacatgggtccagctgactgtttctttgggtctatgacctcctgagcccaggttccttatcatcccatggggcagtaatcactctcctgcccacctcacagggaggaagtggatgtgacctgaattatgagttgtaaagaccgaacactggaaatgattgccactgacggagagagggtataagagtggcccttttggagtacagaggacaccaggagcctcaggctcatgactggcctcatttggttctcctcccctccttgtgtaccaatcacccaaggaaggtgattcattagacttcattagacatacttcccagttcagcttctgtcttagctcagagtaaacaagtgactctctgttcagaaccgaatgaattgcatctggtacttttagtccttgcgtcttacagcaaagattaaatggtactctggaggcttggcaagatgagactcacttcatcagcagagaagaatggagtcacttgggagggagcacccgttctggtatgaaatttctcctgatcacaagtgcttgtgaaaattaaccttttgcatactctcatccttctcaaggaaaggctgaattgcttctcaagttttgtcctgcagccttgggtgagaattctggttttgttgcaaagctagagctcagaaacaagaaagtacaaggccatttttcttggaggaagaaggcaggcagctcagcttgcatgagcatctgacccagcagcccatggctccctttgtgggaagtgtccccttagctgtggaacccaggtgggtaggtgaacacctcaccttatgactgccacaccttatgactgcccattagctgctgcgcctcctctcctccttctcttttcttctgtctttctggaggaatagtctagttcgggttggagatgaacctctggcctgggaagacctctttcaaataagattatgcccatctgtggcttaagaagttactcattcaccaaggcacatgcttgtgtctagaagtaataccatcatgttaccacagtaatattaagtagaacatacacaagtgccatttttgtaaataaaatcaggaaactagccatttcatatggtaattcccagtaactcttgagaatcttgagttgtgatttctgtcatgtagacaagtatgatggaccgaatattcatttcatttctctaccaaattcttgtgttgaagccctaactcccacggtggtggtatttggtgatggggtctatgggaggcagttagggttagatgaggtcaagagggtgggaccttcacagtgggcttagtgcccttataaaaagggacaccagggagcttgctctctctttctccccttgtatgcacaaagaacaggtcatgtgagcatgcagggaaatggtggccaccacaagctaagagaagaggcctcagagtgaaacctgcctcagtggcaccttgatcttggacttcccagctccagaactgtgagaaaataagtttctgttgtttaagcctcccagtctagggtactttgttatgatagcctgagcagactgagatacttagttcagatagaaagtgagaagctaatttgaatatgttctttatctgttcttggcctgttttctttggtctgggcaagtcattttcaaggtgttctgtgaagttcatcttcatcagaatcacctgggaagcatgttaaaaaaccagagtctgggtcccaaccccagagattctgatgggagttatatgtgtggctggactgtgcatttttcgtttatgtttttttctttgagataaactttacatggagtgaaatgtacaaatcctaagtgtactgtctcatgggtttttaataaatgagtccctttgtgagacccaacccctgtcaagatagagaacaacatgaccatcagcccagaaagttccctggtgtcccttcccaatcagtccccactggggatcttcagtggcatcccagagctgtttgctatggtggcagtagctggagagctactgttaattaatttgagcaacagtgcagctgataaatttgatctagcagggaggtctgggactgccatcctgaactcaaggttctcaaatcctgtagctcttgggtcatattgataggggctatatttttaaaaagggatagttgggcagctggttggaaggaaatggcaatgagttcatctttgggcctgtttactgcccccttttgaaactgggtcgtttccagttccgagtggggaggctgcattgttgttctgagtctcagattggagcccattacctgccaggctcctgctcattcttacttcctcttggagggatccccagcaattccaattccactagtagggtttcccagccgatcactcttccctggctgttctcagtcattctaagtgtagaagctacatcatccttggcttctgcctagtggctcacttaaccacatcatctcaatttatcatgttgctgtttatctttttaacataaagttttattatgtgacatactatctcagtctgttccttttgctctaacaaaatacctgaaactgggtgattcataaaagaaatttatttctcacagttgaggaggctggaaagtccaagatcaaggtgccagcagatttggtttctgctgaaggctcactttctccttccaagatggcacaaaagggtcaactcttcttcaagaccttttataagggcactaatctgttcatgagggaagagcccacactgtctaatcacctcccaaggccccccacctcttaataccatcaccttgggggttaagttccaaagtgcattttggagggccatatacattcaaaccatagcacatgcattatctcatttaatccagagctattggttgacatcccatcccattgggacaagaacacacatgtgatagttgagcttaaagtgtcaaaatatggacagtattcagaggaaacagtgatagtgagctggagggttctagaaagatcatgtggaggcaatggggcaagagctggaccatgaagaatggatggggcagaagatgggcaggcaggagaatgggggataaggacctcctagtgacttaggtgaatttagtatgacatcttggttttattaaataagtagcatttgatactctttagtctactttaccttttccttccaacaactctgtgaattagaaagggcagatggttaaatctatttattgttgagaaatggaggtccagaggggaaaaaaatgctttacccaagacacacagtgaaattaatggcagcctgagcttctcaccgttgctatttgagtttctccatgttacttgaccacccactggtatctgaccccaaaagaccttccttgctgacttcctgtggtattttattttgttttgcacagcatggtactgctattaaaaactaaatcttttaaaaacaacatttcctcagtagcatcaaacatatgtctttatcttcttgattcaagctggtcctgactttaagatatcttgaggagaatagggtaagaatacatgtggactttcttccttgagaatatagggaagtattagatttcagagtctgaggttaacacagtggtcaccagcctaatgtggctatttaaatttgagttaattaagtaaaacttaaaattcagttctcggtttgcatttaccgcatcccaactgctcaatagcaacatgtggcttgtagctcctacattgctggtatagaaacagaacattgccattattgcagaatgttctgttggacagcactagcctaaagctgctgtctcagctaagtgacttctctgtaacctctgactctctgtaacttctaacttgtaacttctgtgtaacctttgaccttacaaggtaggcttggagtgcagaggggtgcaatgaagttgtctgtgatacttatgcttatctcaggccatactgtaatgttctctgggtcagctctccaaaaggcacaagcagtcacttgtttttcacagagagagaacccctgattctagctattatactgactctcgtagaggtgctacaggcaggccatgataggatctggagccactgtgttatcatttcttccatagttatagatggagtgctccatgtgtcattagtcatttacactgttgtgtgtgtcagcctcaatgtctacccatgaggatacatgcctgtatttggggaggtatgcaggggaggacagctgcagcccaaaaagctcctatatgaaggaatgagctgccatactgatgcctccattcttaagaatgttctgtgttgtggttgctggtctctggctgaaatttggtacgtacattctttagtttgcaagaataaaaggctcagtgcagtgttataggcaggggtctgctcttagttcaaatgcattgaaggaagccgttttatgcacagtggcttgtaccctgaacatccttttggaaagactaaacaaagagggttattttgtgacttcaccatatacatggcctgaatggatggtaagactgttgaatggaaggttgggtagattagagtgtgctaccaaaggcaaaagggctctggccaggggcccaatactactgtgaacaggatgcaaatgatggtggtctcacaggagacacactaaacggggagttgggtgggactggagctaaccccatttaaggtcctcaagaccatgtaatgaagcaggaaacccaacacacagagtgcatgaaagcaggacacagagatgaatcctgaatgggcagagggccccagagagggagacagtgacttgggttctttaagggctcacaggctatagccacaggctacagattcacctcattgcatcccctgcttctctgtaattgccctggtgagtttccaaatgaagggaaagagccaatagccctttaggaagagatgcactagatgaaaatcacctgattaaaatattgctgttaatcgcaggagaggggggtagggagggaaaaaaaccacaggctcaagcgttaaaagcaataaattatttgttaggctttgccacccagtatgaccttgggcaagtggcataagggccccattctctctgatcctggagcagggggaatgcctgccacctgcctacctcttgggggttttgggaggattaatgacataatgtctgagctgtgctttgggctccttggagacagccactatgtatcaggaattattagcacaagctaggacagtttcttgactattctttacctcattaagctacctatgcctgattacatctgcttataaaagttgctgctcaaagaagagtggactgggaaggtcataacccaggctggatctgtcctggttggtttcattaaagccactccctaaacccacactcatcagcaacagggcaccttgaaagcttagcacagtacccagcatctaatgccagagacggatggttaaaaagaaaagaaagaagaagatcctgtggactttttgcacttctgtgttttgtgttactactaccaacccacctacattctagtgcacctaggggagtgactgccaggttgccggggatgagggacaagctccaggagtcttcagctactcagtttttagaatgagtagctgtcagatggatggacaggttttttcagtgtcaaattttgaggcaaccgactaaagaaaccaggcggctctaagttcacataccaagaaacctatattgattgtgtttctaagtgagggcaagtccatgttgtatgaatgtgtattatgtgtaaaagacacaaaaaagtatattcagtgtgggtctctatcctcaaaggtcttcatccagttggataaatttgacatttattcctagaaagctcaccagccttgatatagaccaggggagaagtcagattaggggatcaaagcacttcaggtcaaaggattcagaggctgagcctgggccaggggcagaggggtgaggggaacaactcagccacaacatcctcgagtgtatccagaggccatgcagacagaggcttgaaccacagttcacaggaggctttcaggtacctgtgatcctcctggaacaggagaggacaggaagatcctaaggtacacttcaaggccatctcccacccacctcctatctcttgggaggctgtcgtgagacagtgtctcatcacccctcaggttctgatgaggatgaacttctgtactccagccccctcagaatagagctgcagaaggtaaagctgcttagctacagtctcaagtggactcctcagcaacagggcatcccgcagctcacgctgcggtcatctggccccttctgttccaaggtcataatttttggtatgaaggacaaagccgtggggagctggcacctttggctactctttcttttgctgtctatgtaagtaataaactgcctgaatccaaaagtggcttgtgatacctttaccagccgaattagtaaggtcttggccttgccttgtctcgtatgcttgaaaagagggtgtgcccaactctcacctcaactgcgccaaagctttaggccaaaaggatagagctggttcccagggcctgtcaaaagagaagggagcaggaccgagggcaaccagcaaagctttagacccatgcagaccagtgccacctggctcagccatcctagcacagctggaattctttccatctttgttgcatcagccacacacgaggacactaatactgacattataaggttgttgttaagattggagataatgtatgttatacttccatagccgtccccgacacaactactaaaacagaaaataacagccactaacatttactatgtgcttgcctcgttccaggcactgttctgctagttttataggctaactcatctgacccttacaactacctttgaagtagatattctttttttatgtagatgaggaagccaagttcagaaatttgctcaaggtcacatacaagttagtggcagagctgggatttaaacccaggcaggctgtgagcctgggttcttaaccaccctgcctcagtggacatcagccacgttcccacactttgctgctgaaaagaaagtaacattttatccagtctaagtgctgagaacagttctggtctcctatatcttagtatcaggttgagcctgagtagaaggaaacaacaagacagaagggctggcagggatctagatagagaagactctgaaagtgatgagtgatctggtttgcaggtggtagaatatgtacttggtttgtagttaaggagaaggacaaacttcaaaagctgtctcataagtcaaaggccccaatttaggaatacgcaagtgttggtaatacatttagccaaatgctggacagaataagctagatgtgacagtggacatgaaaatgccaaattcagaatggtggtcacattttgtaggaagagagagagaaatactatttttcaggctagtatttgatgtattgttactgttttatacctcaaccccttgatttcttgaaacagtgtaaacttggtgactttactgcataataaatccacccattgcacctacattgcaagcaaactccacccactccataaattggtgattttcccgctgcatctcctgtctactttcagatagttttcctaaagccctgactggcaaaagcctaattccgccctctgcaaagatctcaggtccttgtctaacgaaaggggaaaaacattaaaaatgaaatgtttgaaatgcaacagagtgaacagagtgaaaactactgcctatagtcatgtgtcgcataatgacgtttcagtcaacaacagactgcatatacaacagtggttccgtaaagattataatggaactgaaaaatttctatcactcagtatttactgtattttttatgttagtgtactcttctacttattaaaaaagaagttagctgtaaaatagtcccaggcaggtccttcaggaggtattcgagaataaagcattattatcataggagatgacagctcatgtgtgttactgcgactaaagaccttccagtgggacaagatggacacagaagacagtgacattgatgatcctgacattgtgtaggcctaggctaatgtgtgtgtcttaatttttaacaaaaaaagtttaaaaaagtaaaaaaaaaagttttgatagaaaaaagcttatgaaataaggatataaagaaatttttttacagctgtacaatgtgtttcttattagagtgttattacaaaagtcaaaagttaaaattaagtttataaagtaaaaaagttacagtaagctaaggttaatttattattgaagaaaggaaagtattttttataaatttagtgtagcctaagttacaggcacatagttttaaaaatcttttttttttttttttttttttgagatggagtctcgctctgttgcccaggctggagtgcagtagtgcagtggcataatctcggctcactgcaacctctgcctcctgggttcaagtgattcttctgcctcagcctcctgagtagctgggattacaggtgcctgtcaccacgcccatctaattttttcgtatttttagtagaaacggggtttcaccatgttggctaggctggtctcgaactcctgacctcaggtgatccacccaccttggcctcccagagtgctgggattacaggcgtgagccactgcacccagcctaaaaatcttttataccatattttttactgtaccttttctatgtttagatatgtttaaatacacagatatttaccatggtgttacagttgactacagtacagtaacatgctgtacaagtttgtagcctcagagtcataggctatactgtacagcctaggtgtgtagtacgctattgcatccaggtttgtgtcaccacactcttatgtttgcacagtgacaaaatcgcctaatatttctcagaacatgacccctgtcatgaggtgacacgtaactgtatttaggattaaggctttcagtgaagtagaaccgtggacagaaaagaaaagactacctttgaattgttactccttcacagatcatctgtcttctctgttagttttggaaacttgttttatcctgtattgggctgtttcactgcgacatacctaggggtgaatttatggatttaatatatcctgttgaggctgggtgcggtggctgatgcttgtaatcccagcactttgggaggctgaggtgggtggatcacttgagcccaggagttcaagaccagcctagacaacatagtgaaacccatctctacaaaaaaacaaaaactagccaggcataatgacacacacctgtagtcccagctactcaggtggctgaggcaggaggatcgcttgagcccaggggggttgaggctacagtgagctgaggtcgcaccactacactccagcctaggtgacagagtgacaccgtgtctcaaaaaaaaaaaaaaaaaagaaaaaaacacaactatatatatagtggagcaaagccctctgtttttgatctgaaaacttatgtcttatttcacttctggaaagttcacagccttcatctttctgaatagggttggtctgccaccactccaacacccttcccctggatagctatcaaagctgtgttagaggcttaggtctgccctctgtgtcactaactactatttttcttcttcctctactgcattctgggtgacttcctcagcatgtcttccagttcactaatcctatctccatctttgtccagtttggattatcatttaaaatttaatttcaatgtctgtttttcatttctagcatatatacattattcttttttaaaaatatccatgtattatttcctttctgcctgttgtgttttatatttccttattctttcttatagctataattcctttttgcatctcccataattcctaaaacatacatttaaaagtcattgtcaggctgagtatggtggctcaaacctgtaatcccagcactttgggaggctgaggcgggtggatcacctgaggttaggagttcaagaccagtctggccaacatggtgaaaccctgtctctactaaaaatacaaaattagccgggcatggtggcacacgcctgtaatcccagcgacttgggaggctgaggcaggagaatggcttgaacccgggaggcggaggttgccgtgagctgagattgtaccattgcactccagcctgggcgataagagtgaaactccgtctccaaaaaaataaagtcattgtcagactgccctattttcatttaatctcaaataaattaaccccccagtgtcgattttgttggctgtcttcttgagttagttttcttttggtattttggaaattgggtttggaaactcacggagtcagagttcgtttggaggaaatggtcttctctgtgccatccctcccccaacagccttgtgtttacttctccaaggacctgtaagcctataacaggtctcatagtgacatgtcaggaccaccaggacatacagacacagataaacttcagtcttcatacctccatgtggtcttggcccacatgcaggctgtagattgtacatgcttcttcgtaacatcctaggcttcactgtgagctgtaattgtcagatgttttcagtctcctttcatagctggggcagcctagcccaaactttggttttaagtaaggacagtggctcccatcccgccccacttgggctacttttagttcccagtccaccagaatagagctcccagcaccaccacctacattcagactcaaagcacagcgggactgtggcttcagcattcatctttgctttattctgttctgttctttttttcccccgtagatatgtttatcttgtttttaagcataatttacacctttcattttctttttgtatttgatgtttggaatggaggggagggaaactgaatcaaaaataaacttatacactgagcagaaggtgatatgtaaaggaggttaaggacagagtcaagcctagtgagggtagattattccaggcagagggaacaagagcaagtgcaaaaaacctatggtaggtaggcctggcatgtgggaggaacagcagggaggccagtgtggctggaacagggtgaacaagaaagagactggcagaagagaggggtcaaaggtcatggcaggtcagacacaggattttccagggcttcataagtcagctaggaagccagtggtaacttgcacagagtagtaacatggcatgacttatattttaacaggattgctctggctgctgtatttgagaaaagactggggaaggggcagtgtcagggagtggaagagttgagggagagcagttaggagctctggcagtaacccagaggagaagtgaagggggcttggtacagggtggaagcaggggaggtgctggaaagtggttgggttctgaataggttttgtaggtaaagtcggcagaatttgctgaagggttggatgtgggtaggggagaaaggaagcaaggatgactccaaggaatgaaatgccattacttgagaagaggaacatgacagaaaaggtttgttttggaggaagctcagttttaaacaatgaaatgaaaattagcccttcttacccgactacaaagatatgataattactgtaagattcaaaagaagactgaagactgttactcagaatatagaaagaactctgaaaattcaataagtacacaacccaattaaaagcaggtaaaagatttgaatagagactttacaaagaagagatagggatggcaaataaacacatgaaaagttgctcagcaacatcgggcatcagtaaatgcaaaataaaaccacaatgagatactgctacgtgccactagaatggctaaaattaaaaggctgatactaaaaagtgtcagtgaggaagtggaacaatgggaacccatacattgcttttggtaatccaaaatggcacagttccttcggaaaagtttggagtttcttataaagctcaacatacacctaccatgtgacccaggtattccacccgtaggtatttacacaagagaaataaaaacatttgtctacgcaaacctactcaaatatccgtggcagctttatttgtaatagtgaaaaagtggaaacaatccaatgtccatcaacagatgagtgaatgaaaagtggttcacccatacagtggaccactactctgcaataagcagcaaaacactgacacatggatgaacctcaagaacataatgctgaatcaaaggatccagggttcttcccttccccccaaaaaagagtgcatgatacatcatgtttccgtttatgtggaattccagaaaatataaaccaacttatatagtaacagaaatcagatcggtgatagtctgggtatggggtggaagaagaaatggactatcagggaacaagaaactttctggggtgatgaaaatgctctgtatcttgatagtggtggtggtttcacagatgtctgcacctgtcaaaactcactacacattgttatcagtaaatgattagtttattgtatataaacacctcaattaagtctgtgtttgttttttgggatgtggtggcacaagcctgtagtccccgcaagttgggaggctaaggtggaaggactgcttgagcccaggagtttgaggctgcagtgagctatgatggtgccactgtaccccagcctggacaatagagcaagaccctgtctctaaaaaaatgtttttttttttaattactgaattcaggatatgaacaatgacagcattcttaaaagagagtcaacaagtctaccatagagctctatgacccaaccaaaagtcatagtaattccagtgctgaccacttgattatcaccagcagcctcagttatgggcttttaattcataaacagatgacttgatgaagaaaaaagggaactttactcttctgattcaggtatggctaagaaccaggccatgaaacacccaaggacctaagacacaatgcccttttaagacagctagcatgaaagtggttcttttccatgcctcgtacgccctaattgtggtagaataaagactgacatcccacaggatgtaagacgtgtgtttattaaggacatcgacttgtgccatctcactcaggtggggctggcaccattcttattttacagatgaggaaacaaccttggggaaataaagtaattgcctggagtaatggagctcagctgcattcttttttaaaaattaaataagaaatttttaagagatggtctctctgtctgtcattcaggctggagtgcagtggcgccatgataggtcacctgtcaccttgaactcctgggcataagcaatcctcccacctcagcctcccaagcagctgggattacaggtttacaccaccacacctgcctaagtttttgtattttttgtagagacagggtttcgccatgttgctgaggctggtctcaaactcctggcttcaagtgatccccttgcttcggcctcccaaagtgctgggattacagggatgagccactgcgcccagcctgttcttttcatcacatgactccactggtgatagtcttgcctcactatatttttccttttctccccatttaccatttatttgcataattctttaataacagctttattgagatataattcacataccatataattcacctatataaagtgtataattcagtggcttttagtatattcagagttgtacaaccatcaccacaatctattttagaacattttaatcacctcagaaagaaaccctgtaccttttaactctcactcccctgtcttcccattcttctacctccccagtgctaggcaaccactgatcgactgtctctgtcctattctgggctttcatgtaatagactcatataagatgtggacttttgtgactagcttcttttactcagcatattctcaaggtttattcctgttgtagcatatatcagtactctgttcaattttgtggccaaataatattccgtggtgtgggttaaccacacttgatgtttccattcatcggctgatggacattcacattgtttccactctttggttattaggaatagtgctgctatgaacgttcatgtacaagtttctgggccatgttttcttttctcttgggtatatactcaggagtggaattgctgggtgtcatatggtcactctatgtttaagcctttgaggaactgccagactcttttccaaagtggctgctccattctgcgttgccatcagcagtgtttgagggttctaattattccacattctagccaacacttggtatgacatgatgtctcattatggttttgatttgcatttccttgatggctaatgatattgagcatcttttaatgtgcttgttgacatttgcatatctcttggagaaatatgtattcagatcctatgcccatttttaattgaatagtttgtctttttattgagttgtaaaagttcgcatacattttcttctgtgggttttatacctttaaattattcatttatttattcttagagacagggccttgctgtctccaggctggagcgcagtggagccatcatggcttaatgcagcctcaaacttgtgggctcaatcttcctgcctcagcctcccaagtagccaggattacaggcgtgtaccaccacacctggctaattttttaaacgttttgtagagacagagttttgctatgttacttaggctggtctcaaactcctgagctcaaataatcctcctaccttggcctcccaaagtgctgggattacaggtgtgagccatggtgcctggccttttttacactttcttgatggtatcctttatagcacaaaagtttttaattttgatgaagttcattttgtctattttttccttggttgcctatgcttttggtatgatgtctattgccctactttttgcatgagaggtacatgggcctctttgtatctgaacatcagaaataaaagcaggatgggcaggatcaggactgcccttcagatgaggttacatgactcttctaaggtcacacagaagaggcagtactgggatccaccgtgggccagtgcaactcgaagcccttattcatcatagcacaccacagcatagcacagcatcatcagggagtggagaatgagaggttctgccttaggcccttcactaaagtgctcgctcttaacactgtgttgagaatccccttctcagaatggttacttggcaaatgttgaattatttctttcatttttgtttctatgtttttccagtgaaagaaatttaaaaaaaagaaaaaggaatgaacttaaaatcttgactggagggtaatgaacctgcctctcaagggcctgccttcctttgcattcagaaaactactcaaggttacaaaaaaccaatacatcccactggttccttgtaagaaattctccaaatatcaggaaatattgtgggaaaggaatgcatctctctctctctcttttttttttttttttttttttgagacggagtctcgctttgtcacccaggctgaagtacagtggcgcgatctcggctcactgcaagctccaccttccgagttcacgccatcctcccgcctcagcctcccgagtagctgggactacaggcacccaccatcatgcccggctaattttgtttttgtatttttagtagagacggagtttcaccgagttagccaggatggtctcgatctcctgacctcgtgatccgcctgcctcggactcccaaagtgctgggattacaggcatgagccacgatgcctggctggaatgcatctctttgacaatgcatgttgccacttaatactgccatttgttacttttaaaccgtgttatacatagagccaattcatgggaaaaagccctggttagcttcaaattttggtcacctgtcctgtcagcagatgcatatacattttataattgttttcaaactcccgattaaacaacattacagtaaaggagggctcagctcttaatcactgttccttgcctggtgtccagccacaaggtcattgcttagcaaatgttgatttaaatgagtagtagaatccaaaaaagaaaaaatctcctactattcttactctccagtccattaagtttgtaaattctttgtttccttttagttttcatctagatacagatgtgatttttatttatttttatttttttgagacagagtctcactcttgtccaggctggcgcgccatggccagatcctagctcactgcagcctcaaccttccaggctcaagcaatcctcccaccttggcctctcgagtagcaaggaccacaggtgcatgccacctaattttttaatttttgtagagacaggggtctcactgtgttgcccaggttagtcccaaactcctgggctcaagtaatcctcccatcttggcctcccaaagtgctgagattacaggcagatatgatttttaaatctgtacattaatttttctgaaaattctgtacatctaatactatgttgtcttcattattatcttactgtggtgacattacatcccataaattatgcacattgtttttattatatagtctttgggggaactttttttttctttctaagttttcacagtttagaggaggactacttgaagatttcatcatataaagttactactttggctgggtgcagtggcttacgcctgtaatcctagcattttgggagtccgaggcgggcggatcatgacgtcaagagttcaagaccaggccaggcgcagtggctcacgcctgtaatcccagcactttgggaggccgaggtgggcggatcacaaggtcaggagttcgagaccagcctggccaatatggtgaaaccctatctctactaaaaataccaaaattagccgggagtggtggcggacgcctgtagtcccagctactcggggggctgaggcaggagaatcacttgaaccagggaggtggaggttgtagtgagccgagatcgagatcgggccactgcactccagcctgggagacagagcgatactctgtctcaaaaaaaaaaaaaaaaaaaaagagttcaagaccagcctggccaacatgatgaaacctcgtctctactaaaagtacaaaaattagccagacatggtggcgggcgcctgtaatccgagctccttgggaggctgaggcaggagaatcgcttgaacctgggaggcagagattgcagtgagctgagatcgcaccactgcactctagcctgggcaacagtgcaagactctgtctcaagaaaaaaaaaattactactttgaggttatttcctcggggtctgtttgaaaaatgaaattgtgggggaaggacataacggagcttgggcattgtctcattgccagaccgcttccccccaaatttgagccaatttgcagcatggccagaatgtgtttgcccaagttgggtttagagctggtttacttggctgattttgctgttgtattcatcaccaataagatggatgatgattctgttttcttactataaattagttgcatatatcccttaactctcagtcatttcattccttgcagtgtatctttgttctgtacctgctcatatggagaagttcaaaaaatacattagtactttctgccccactttgtcactatctagttcactaattttcctaaaggaattgacttagctcatgttgcttcatcatttataaacatataaatgaggcagaggttgcattgagcgaagatcatgccactgcactccagcatgggcaacagagcgggaccctgtctcaaaaaataaatgaataggctgggtggcagaggtgggtgggttacttgagttggatccaggagtttgagaccagcctggacaacatagtgagaccctgtctctactaaaaatacaaaaattagctgggcatggttgtgcatgcctgtaatcccaactacctgggggactgagtcaggaggaagtcctggctgcagtgagccaagattgtgcctctacacgccagcctgggtgacaaagtgagacccctgtctgaataaaaaataaattaatatagctttggaattttttttcacttatttttctagtttcagttcagcatcatgtagtttgaatgatttgttgttttatagtattgtatttcatcttaatttagtaactctttgatgtgtttaagcacctaatccttttcataataagaacgatcaaatgtcctttataagttgccttgcaatttgaagtaaaactgtgtgagtgaatttctgtgtagagaacaatacttgtcatctggtaggcacatgagtcactctgagtcacttcaagaatgaatttagaattaatttagcttaaggtttctatagtctactggatacttaaaaaaaaatttaacttacgaggcatcttatctatttgaaactagcaacagccattctaagtgagggtttgtaaagtcaggcgtgagatatacatggggccatatgtaagttttaacataattctctgacaaaatgaaattctagggcgtgggagatactcaagagaaaaggtggatttgaaatgccccctgcttccccaagtttctgacaggtcacttctcagttgtgcatttggtacagaggaatgaaataggtatagaggctctttttggtttttctcaaaaaaagtgatacccactgggggagactccagccgagtgttctgaaagccagagtcctcagccgagagaactccacagtcttcaggccgttcccagctggaattctctgtgaaacagcagcaacagccagcagctttttggtgtctggggtagtttctgacccatcacagttcccttcattgctatgacaacagggagaataattattcaggttctgtttgattctagatccagaaaaaggtttaggctctttgttcaaagagcaaaagaattgtccgtttctttgtacatagaagagggaaaaaaaatccttatgattcaagagaaaaatgggtgcgtctgtcctttttcctttctttcacgtaaattataagtcttggttctagccaccacaccttttaagaaaaggtctgggactgatgtgagactctgtaccacagcgacaccctaccctggccgacagtggcaaaagaacaaaaggaaggaagtttcccttttaaatccccaggaattttttgatgagataatattacagagtgaaatgtctcgtcctcctattagtttagtatttggcttctgtgtaacagtaacccacttagaagcaggcggctcttttgaagttattttaaactctcagcctagtgtagagatttgtaaccttggataaaagcaccactagccctagtttcagttttgccctttcagacatgtggaaagtgcaccagtatatctcaaggattttgtactgaaagcttcttaaagagctggtcttggtttcaaagtttggcttgatgtaccatactcaagggaacatagttctttttctccagatatttaaccttgtctgacatcgtcttttggcttcgaagttcccctagcttctttgtccattaacaaaacatgaaaccacatgaaaccatgatagtcagtctcactgggctctgaggaagttgaagaaagttcatcttcatatttaaacataaaaccagttgtttgatacctggtaccagagatggccaggtatatgcattgcttgttggtagcattttgccttagtaactattcagaaatgcaagtggaatgttgagttcctcttctagaggttatatctgtatctgggagaaaattggagcttctcagaacaatcaccctggttattgtgtctgccgtctctgtaacacccaaatctatatcacactctgatgccacctgggagctatttttggttgcgaagggtggtgaaagctgctggttctttctcttaccgtgtgtccctgagtcatccccagcccacgtcctggatggctcccagaacagccgtctcagacgaagtctcccttcagatgtccactcctcagtgcagggggcctgtggggtctctcttggtcctgatgaaatccttctctgccttttccagtgagaaggacccatagaatctgctggaacacttggagaaagggacttatttccagcagtgcataaaatttttgattaaaataattcacgtgtctgtttataaaaagacaaagcgtacatcatggtttataataaaaaagagcattatcttgtttcaccttcaccacccctgattgctattcccagaggcaaccattttcaattctttagtggcttcttttgtcttcatctctgtgattctttctaaatttctgtaactcttatagtcaattgcagaataatttattgacctcctcctgtagaaaaagattttgcttttcactcccctcttctcattcctgcattcttccaatgtagttatatcacataggtcataccctgattatgggttccaatcctggtgtaagtttttgttttttttctggagttaatcattgctcccctcaccctggccctccattactttagtttgctgtaactatcacgtgtcatcctcttgttcagaactataaaactctcctcagtaccatctaacccactgggtaatgagtcatatttttgttgttatttgtttggctgtcctgtagcctcatccttctggccccatctggacctgtcattcaacaggctggttgcaaagccatcgtcctgggatttctctttatttctctaatctgtgggagtccctgtgcttggatcccatgcctgccttttccttagttttatttctttgttttgttgttgctgacagcaactcctgaggttggacgtggatgggaaaatttgagacttgcttttttggggaggacatcttctattctccttccccttctactgtcctttcaaggtgctgtcatggtgaagggcaccagtgttgtggtctctgtgtatagaaagcagtagccaccccagcgttcttgggctgctgtggccccacagcaaggccaaggaggagcagcctttgctcctataccattgccagtaaatcttttttgtcctggaaatgtctttgatgactcagtaatcaataactgtaagagctaggtctttcaaagttcatgcagcaagttaattaaatcctgacctatttgccctggtccctcacttagcagagcagagacccaagtggctcagcaaaaacagcaagagacatggcagcaggcctgcctccaggccagaggtcatttgttcagccagcagtcatttattgagcacctgttgggtgcaaagctctgtgtagggtgaaaggggacttctgaataagactgtctttctagaagcaggtgcccatcttagaggggaggctgtaggaaccagtaagcaccatacaaagcatttgagaatcaaaaagtattagttcattcaagaaagctccgtggaaggggtgatatttaagttggtcttgaagggcaaagcattcaaggcaaaggcataaaatgcaaatggacatgacaggtctagagaaggtgaaggagagagctttcccattgatggaacgtctactggtgttactatgttgatgtattttatctcatttaatccttaacgatgtctgtatttgtccatatcagttaagacagatgctacagtctccattttacagataagaaaatccatatggaaaacagataggggcatagagtgtggaagtacaggcattggagactcagaagggtgggtggagggggggaaggggaatggattatgggaaattacttaatgggtaccatttacattattcaggtgatagatacactaaaagcccagatttccccactaaacaatatagccatgtaacaaaatcacacttcaatatatacaaataattttaaaaatcaaggtttatagaaatcaactcatctgcctaggtgatgtgcctcataaaaggcagaagtgagatttcaacacaagattgcatgatctcaaatctcattccttccttcccaaaatatcccttggaacaaaataaggagtgagagggtaagagccacagtttcataataatgtcaaactcttgataaaggagtgagtaggcattttccttcagttgacttaagcaagatgtcaagtatcccaaagttattgcacaaagagcaaaagtaaaacaaaatcaaagttataacccaggacatattttctgttatatccttgcactttcattgtagcttattaattatttgcatgaagttcttctgtgaatctgccccagaagtttttcttgtcttctcatttcaagccatccttccccttagtattctctattggatggagtcttggttccagtctagggtttccatgtctatttgatttttttctttacgttttcattagtagttcttgagttcttacacacaattcagctgtttttaatcttcttaaaaataataaggcaaaaacataaatgtcaagcatctgactaggaaagccctacccatccaaatattttaagaaaataaactcagaaatgcctataacttttaaatgcttatatgctacattaagttcaaagttaacatgcttaacaccatacacggaagtatcctacgatgaattttcaatgattaggcgttcagaaccacacaggtcttatatgtagtcagtgcctatatgtcgctggctagtgttagcatgtgtgaataacacgcctggtttttacctgatgactgcagggatggtgtggaagtagtgtctagctgaaactttgggagagtttaggaatttcttacagagaaggttcttattctctacagatgattgttatccagataaggaccttgggatcttttaaaatcagaggctaataattcttttttatctttttaaaaaaattgagatgcagtcttgctatgttggccaggctggtctcgaactcctgggttcaaaccatcctcccacctcagcctcccagtagctaggattataggtgtgtgtcactatgcctggtttagggcctagtatttcttaggagaaagtagaaataaaggtttcattggggctatatcttaaaaaataaaaatgaaagtaatggtttatatttaaattataattgcagctttgtactgatttttgagaataaacaaagattgaatctcttgtgggccatgcggggatattctcagcaaaactgtataagactgtgcatatagcatccttcacttaggtttgagttcagccgggtgcgatggctcatgcctgtaatcccagcgttttgggagtccaaggcgggtggatcacctgaggtcaggaatttgagaccagcctggccaacatggtgaaaccctgactctactaaaaatacaaaaattagctgagcgtggtggcgggcgcctctaatcccagctactcaagaggctgaggcaagagaattgcttgaacccgggaagcagaggttgcagtgagccgagatcgcgccactgtgctccagcctgggcaatggagactccgtctaaaaaaaaaaagttgttttccaactgagaggactctcactttttccaaaggtctctcttaatcctttgatcattctctgtggaagctcccatgcgtgtttcttcttctttaatccttaactagattgtttgccattggctttgagtggaatccagttgttgactaataggactttcatggactctgttaaattctgcattggttgctgatttgcagttctagtttgcaacttatttacatagtttagtcactatatcatctgatattccaacaattagcaggagttcactgttggattaaataagagattaaaatgtgtaaaccggtcaggtgcagcagctcacacctgtaattccagcactttgggaggctgaggcggaaggattgcttgcgcctaggagttcaagaccagcctgggcgacattgtgagacctgtctctacaaaaaaaaaaaaaaaaaaaaaaagtcaataaatgaggtggcaagattgcttgagcctagggggtcgaggttgcagtaagctgtgatcacgccactgcactctcatctgggtgacagaacaagaccctgcctttaaaaaaaaaaaaaaaaagtgttaacattgcagatgtccagttaataggaaaggcctctgtttcacttttcccataaaatgcaaatgaaatggtatgttcatttgcattttatgcctttgcctagaatactccatccttgggacaggtcagttccctaagaatattttcacataatgactacttctgcttctctataaaaacatctcctgagctcgtaacttggagcccttgggaaaagagaacctcagggtggaaatggctggaggcctagggtggccgatgctgtcgtcaggggccagctgacagagacctgaatcgtataatatgatattcaataggtgggtcaaaggagcctgttagattgaattaacagacttgcactggagatgtaaactggaataaggagctcaggagagagggaacttagggtggaagtgggaaggtggaatggatggtgaggtaagttttctatcctctgagatgtgatctcagtggcttctttaccctccacaagagggtaaagcgtccctcccactggcactttagaaaaattccttttagttttaaaggctttcattcctgttcagaagtcaatgcccttgacggggctgatgtgttgagctgctaacagtcacccatcccagtgtcaggaagatttgatagaggagtttggaggagagtgggaaggaatgactgcttaggaggggagagagcctggcaatgaaatgtggcccagggcaccagcctgacagccccgagggacccctgggtgtgtttgaggctttcatagttcagatttctgcatgcccggacacgctctccacatgcctttcctgaggccgtgtgttctgctcctccaagagagtaagcctctggcctggtcaggcccacttccacctcactggctgcagtgggtcaggcctcggctttggcttcagctgcctcttggtttccattccttgtcttctccccgtcctccacatctgccgctctcccaagccttgtcttttctccagctgccctcgactgtccctccatttctttctaccatggccttaagtctttgcgtcatggatgttcagcatttgcagacatttagctttacctcatgtcatatttactgtaggtttattgccatgcgtgtgtatgtgttctccctaacttagcatctctcaacgtgtgtcccatgaaatagtgtgatcagattaaatgcaaaacaagtttataaacaaagggtaggaaatggtggttttagcaaaggttaaaagcctttttaaaccattggccactgcagagctttaattcacacatgtagatcctgagtccctgtgaagagtttctcagtgttatttacttgtgcaagaacctgtttttcatcttgtggtaggtagtattctgcaggacccagtttcctgaagggctgctggaattcacttaggctctggaagggtagaaaccacattgtccttcactgtgggatccccgtgttagctgagggcagtgctaggcagggcgtaagtcattcctgagtaagctcttaggacagttgcttgttttttttttttaaaaaaaaccttttaattgtgaaattcatataaaattcaccattttaatcattttaaagcatgaaattaagtggcatttaatatgttcacagtgttgtgcaatcttcaccaccatctagttccagaacgttttcatcacccagaaggaagccctgtacccattgaacagtcactccttatttgcccctccctgctgcccttggcaaccactagtcttctttctgtctcaatggttttgcctcttctggacatgtaatggaatcatacaatatgcggtgttttgtgcctggcttctttctttagtaaagttttgatatagatgcaaagtcttagacccagatgatacctatgctcctccaaagcaactctttatcattggccaaaccccataaatgtataagtaaccaaaagcagccattcatctggaaacctccaagttgtgtggccaggttaaaaataccttggaatactggttgccgttaccatgatttgacctgggacttcaggaagctggctgagctgtgctggagtgagccgggtcttgagccctttcctggaggtcagaggtgcctgagctgttgacataattggctcatccctcttgctcatcctttttctagttggaggtctcagcatttcagactactcattgtttaataactgtagaacattctagagtgggctgaatcctgcacgggcaccctggaggaaaggttgccccacccatggcaccgcagaacctccattggcccttcaggcaaattccatgagcctgaaagtttgtgcaaagttagatcccagggccctctatctcatatcttggaattcccaaggggtgggatatctctcacccactataaagacagctgctggccgccctgtgctcagcagtggtgacctctcacctgccttatgagcttgtgcaacccctttcctgttgtttcattgaattgtcaaggaactctcatttttggcctgcaccctttgccctccactcgttgctgtctctggagtccaagaataccactgctccaagaggttacctgcctgcctaaaataacttctttcagtgcacaatcttctgcctaaggacctgtaatgctgtcttggtgtccagactccatcctggtttttgagcccttctctttccttctcagtgtagacagtgacccttcctactcatcagactggatgcatccttttctcccctctatatcatctcttagcaactcctccccgggcttggaactgacctctctctctcgttttgccctgatcagtctaactcttccttctaagctcactcgaggctcagcagctgcgcaaagcctccccaaacattctagcaactcttgctgcctgcaccaaactcatgttacgcttgaataccacaggatttagagctggaaactttttttctaaggattttatctcttagtctttccctgtcagatggtcagctctcagaggaagggaagataaagtaagcaagtggtggagtgggaaggcactggattgtgaatccaagggcctggtcacctctgggtgtgccacatactggctgtgtcttggaaaagccacttatcttggatttctgttctcatctgtaaaacaagtaggggataatgtgggtgtattagtttcctatttgctgctgtaacaagtttctacaaacttagtggcttaaagcaacacaaattcattctcttacagttctggaggtcagaagtcccaaacaggtcttcagggctacattctttctggaagcttgaggggagaatccatttttcatctttgtcagcttctagaggccatcgtcatttcttgattaacggccccctcctccaccttcaaagcacatcagcctctgcttctgtcatcacatctgttctccatctttctcatgcttccctgcttcccttataaggacctttgtgattgcactggaccaacccagataattcagtaatctgtccatctcaaactcaatcacatctgcaaagtctcttgctgtgtaaggtaacttatgcacaggttctggagattaggacatagatatcttgggggccatattctgtctagagtgcattcttaggtctcttgtgtttctaacttgtcatgaatctaaagacgtatttcttccacttatttaagagcttagcacacacagtgctaggcttatcagcttcttgataagttatgtttatccctgaggatttcctcttctcagattgttattagggattctagggcctggtaccactcagtgatagaactgtgagcacaaaccttagggttgttctggtttgactgcactttcacacacagaaatttgacactgcttatctgcccatctttgattttgtgctttgcaaattttgaaaagacctcaaagaattttatctgtttcccagtaaccaggggtagcctttaaacagcctgttaattacactggtgatttctgtggtctctgcatagagtccgggatgtgtttccagatcctcttgcgtaagttgaagtagacatgttgttgaagtctagaagccaaacaatcttggatactaacatagctagtctcgtctgtaattgctacttagtgttaaatttatggtatttcacagcaatttagattggcatttatatgggaattgtgctgttttctttccctagatcctattgggcagtttccaccttggatcaccatcacttacaaggcagtaaaaaagcatgcataacatacatttataatggctctatagtgttctccccagtgctcagctcattgtgctgaaataaaattccccttgggttgaaaaactgtccccactcttaaaattttaagttttgacgttacttttggctatagcatctgagaaatacacaatatgagtcaagcaaatgtgtagcttgcctgctgaagttttctttccattttatttcctagatgcacccactgggcctatgtaataacaatgacgaagaggacttgtatgaatatggctgggtaggagtggtgaagctggaacagccagaattggacccgaaaccatgcctcactgtcctaggcaaggtaagcaccaggcccttggaatcactgtgtttctggttggtgttttccactcttccatttcagcattcctcaaatagttgattatggagaagagccatgctggcacagtgctccttcccggctgaagttgcatgaggtggggactgagacatgccttgcagtggcccaccagtgtttacaagcccagactgaaagagactgccagtctcagagcgggctctaccctcttgtccattgtgtggccttgggcaagttgcttcccctcaaggagtcttagtctcttgtctgtgaaatgggctaataatagagattcacaatactttatcttacacccttgggccagatgtttcagaattctgagatttggggggtttagaaaggcattaaggggtatagattttatattaagtaacctccaagagacatggggaggcactcagtaaccaaacacattcacatttgtatagcaaaccatagagatcttcacattaagtgggataactaaaatctaaatagcctcgtgttagttcacggcagctttgcctccagatgagttcaggtccattaagttttgctgccaagtaagttatgggaaaatgtttcggttttagagctttttttggtttcagaatggcagacagcaattatggtcctgtattagaacttacctcataggtggttaggaggtgagatgagatgcaaacgcctcacacaagagtaagccctcaataaacgtttgctgccattggctaccatcactccatttagaagtactaaaaaagactttttagccaagagggtcagcattactttgactgcagtataagatagaaataaatttactttggaaagccactcatcaacaatcttaaaatatgacaggtaacaacctgttttaaactggattttgtttagactgcatcattttgttaaaaggagaggttcagagaaggtgatttgaattttggctgggagaaaggtagtctgtcctaaggatagtggtactgactggatatcttttatattctcaaaagctgccattctaggtaccatggggagagagctggggcaaaaaactgtcctggttcctaacctcttgaggctctcttgagaaatccaggagagacaaggggtggttttgaagcagggtgctagagagggaagactttccagacttaaagtagcccctgccagtgtctcctgaaagacctttggctccaggtaccctcacaggtctaatctttttgtggtttttgcatccctcttgtcttctgaataacttcaagtcacttgtcaagttctcctgccctttagttggaaaaaataaccccacaggaattattagctgtttgctttacagttcacaaagttgaatcgaggtgttttaggtggctcaggccctgatacttcatcatttaaataattggccagagctgcttagtggtggtaggagagcaatgacccccttgagaatattttagtgttttcttaggagaaatgccagctacatctacagggtaggaacagtgctttccttgtaggtgttacgctcctaatacaacattttctcttgtactttatgcaggaattggctccttgacttcatttgctttgccccggtctggtggggctccatctttgtgtctctcgcatctataaatgggttggaacagggattacagggtcaccctatagttctcccatggtttagcggtggggaaacttgctgaagtcactcagagaacccaactatttcctcctctgcctggaacaaccatgtagtggttttacttggagagttttgtatgatttggcctgctagcctgtgatgccagggggaataaaaaaccctaggcatatattgaatcattaagtgcttcttaagtttattcactcaccaaatatttattggatgcaggggcccagaagctgagcatgtggttctacctgcttgcaagcagcagcccccacgtttctctggagaggctggtggcgggcagcatttgcacatggttagtcattgcagtttggctttgagtttacacctgaataaaatcattagcacagaagcttgggccaaagaaagacagttttgcatttgtttaaagcctgggccagtgtaggaggtgcgatgagtcaagatctctctctcttcctccctctctctcctgccgcccctctttctctcatcatcttcttaaagtgtggttgttctcagtctcaatttcattaactttgacaactgcgttttcttgttttatgagccccccgggggctggtagcaaaaaaataggttaaaggaaggcaaagttatccccttgggcagcttagtccctgcagaattcatgattttccatccatttcttggctctgaagaagcaggcagtggacagaggcagaaaaggcataggaggaaaacagccaagctagcttgggggtgggagctccttcctgtggatgttgaaacttgttgaaaacccacgaagggaggactctgtccgctgcaggcgggccaggcattcggaaaagcctgtgggagaagaggggtggcctagacacaggctaaccccctccccaccacccaccctcttcacctacccgcgtacttacagacaatgccacagggtgaaaccttgaaataagagaggatgtcctaaattaaaacacgtaaatgcctctccaagagttcaaataaaatttcattttaaaagcaaaaggcataaacttgtcacctcagtttattactgagtgcttttgaacttctcagaaaagaactctataaactcatgagagaaatatgatttatgatcccctccttctcttcttttccattctgtgggaggaggtacagtcaggatcagctagggaggcagcgttgggatgagggcaagaccccacaggggagcagcaggccagggcgccaggccaggcccagcctcagaccaggcatgggcgcatctctccagctttctgagcctctctcctgtacttaatgtggagaggctgttgtgggttccttgttcttctaatattttgagcttctgtatcatatttaaaatctttctttgatattctagttcggagagattctagttacagcattgaaaaacaggctctgttacctgtggcagtttaagtcctaagaagttaaaatagaataaaattgacatttcttagagtttgctattaagtaagggtcttggccaggcacggtggctcacacttgtaatcccagcactttgggaggccgtgccgggcagatcacttgaggccaggagtttgaaaccagcctggccaatatggcgaaatcccatctctactaaaaatacaaaattagctgggagtggtggcatgcacctgtagttccatctgcttgggagtctgaggcaggagaattgctggaggtggaggttggagtgtgctgtgatcgcaccactgtactctaggctgggcgacagaggaagaccctgtctccagtcaatcaatcagtcaatcagtcaatcaatgtaagggtcttaaaccatccccaaagcaaaggagtctatgtttatgtcccgggcatcttaaccctccaattcaatcagtgtttattaagcatcttatagagctaagaattttgaaggttgactttaatagctttacctgtggagagtctcatggcagggaacatgagaggtgctggcgtttctagcaaagcctggttggccctgattctgtaactcaaggcagaataaatgccccataaccaccaccccatgttagagaagattcttagggagaggtttggaaaacagcatgggccaggcgtggtggctcacgcctgtaatcctagtactgtgggaggctgaggcgcgccgattgcatgagctcagggatttgagaccagcctgggcaacatggcaaaacaccatctctacaaaaaacacaaaaattagccagtcatggtggtgcatgcctgtggtttcagctactcgggaggctgaggtgggaggattgcttgagcccaggaggtcaaggctgcagcgagctgagattgtgccactgccctccagcctggccaacagagagaccctctctcaaaaaaaaaaaaaaaaaaaaaaaaaaaaaaaagaagaacagtatggtcaataggcatggccttagctctctccaaggcttaatagtacaatgtggggaaattgagaaaaagataagaaagggagtttcatgtcacagagacccagccttggctgactgacctcagaaagggtacttcattcagttctcggtgcattctcctctgtgcagcagggctaatgctgcctgtgtcattgtagtgggggctctgtgagatatttgtagagcacttagctcagagcctggcttatgggaaatgttggatgaccatgtagaagtcagccatcacatgttgggtgctcgccgagtgctgagagctttacctatagcgtctcctttaattaatgctaatttgacatcctatccagattcccattttaccataagcaaatcgagtcctagagagttctctacataacctgaaattgaacagcttacaagagccaagatctgaaataagacccttctgcttcatcaatgttggtttcttctctttgcctccttttgtcttcgccagtttttctagataaaaatcagatgctcacctgggcacggtggctcacacctataatctcaacactttgagaggctgagtcaggagagctgcttgaggccagaagttcaagaccagtttgggcaacatagtgagacctcctgtccacaaaagaataaaaaaaaaaaaataataagctgggcatggtggcacgagcctgtagtactagctactcgggaggctgaggcaagaggatggcttgagccaaagagttcgagcctacagtgagccatgatcatgccactgctctctagcctgggatatagagtgagaccctatctctctccctcttccccccaaccccccgccccggccccgcacaccaccccccaccccccggaaaaacgaaaaagaaatcagatgccttttagtagtcaaaggcttggttaaaactgttagttccacataatagaaactcagcctgagctctgttgagcagaaagaggaatttgctctgaggattctgggctatgtcacagaacccatgacaggggtgctgatgcccttccacagcacctgactccagggcttggatgccagcggccccctcctcaactcttctccatccacgcatctgctttattctctcactccccatttggtaggagacgcagccccccagtctccctgggcatgaactctctgggttttgagtctgaaaaattccagaaaagggattcattggcccatcttggatcaggggctcacacttaggctagtcagctgtaccctgggggctgtcctgccataggtggggagcaaggggaagatgtgttctccagaagagagctggtggggggcagtgctgggctgtcatcctcatagcaggcccctgcagtcactaaatcatatatgtgatcatgagcttgtgggtgatgtcctcagtctatcctgagtcattcagagaaggttcagctggaagaaactcatggtctatgtgtactacatagaatcaaatcctcttcttcccctgaacacagagagtgattgtggtgagtgaaaagtgagtccacgtggactggaggagttgggcaggttttacagagtgggggttgtgtaagacagacgtacgaggagacaggatgaggtaggaaaagaatctccagaacagggcagaagaaaagggagcaagatgttcttcaaggagcattgaaagttgctgctgaaggaagaggctctcaagtgaaagagtttggtcttcattctctaaagagctgggagccactgaaggcttctgacaaaagagcaggtgttgtagaatctgtattctgggaatgttcacttggcagtggcatctattctggttggagagagatcaagttaccctgccactagatgttttgaggaacccagtggaaccaggcatctgttattttaaatgctttagtggggctcaagcccggaaattactgagggctcttcatgtttgccatctctcctttctgtttgcacatttaagcaaatgtgaaatgtaggagcaacatgtccaacagcatgggaaggtggaaaactatgttgaaagggaggagagctggtttttaatcctggctcttctgataagcagcggggaaaccaaggtacgagaggtgggtggaaaattgaaccatatggtcagcccactaacccacgtccagccctcagtgtcttgggaacttctttgcaaagcacaaatacagactctggtaaccaaaatgaccagaagacagagaaccgagtcaaaggaaccttgacttttcaaagtgattgggagagggggagcatgtaagggttaagacttgggtttagtcatcatactaacacaggtttcaaccccagttctaacccttttctgagacagggtcttgctctgttgcccaggctggagtgcagtggcacaatcatggctcacttcagcctcaaactcccgggctcaagtaatcctcccacttcagcctcccaagtagctgggactacaggtgtgtgccaccacacctagctagtttttaatttttttgtagagacagagtctcaatatattacccaggcaacaggctcctagactcaagcgatcctcctgcctcccaaagtgctgggattacaggcgtgagccaccgcactcagccccaagccttctaagctctgtgagctcctgcagtcacttaacgcgtctgtgtgtttagatgggaatagcccctaaaggagataatgtatatcaagtgttgatcacattcctggcacaaccaaaagcactaaaccaggtgttgactcttattgtccatcttctcttcctttctctctccctcctttattgtccttcagttcctttctttttttttttttttttttttttttttgagatggaatttcactcttgttgcccaggctggagtgcaatagtgtgatcttggctcactgcaacctccgcctcccgggttcaagtgattgtcctgcctcagcctcctgagtagctgggattacaggcatgcaccaccacgcctggataatttattttatattttttatttttagtagagacggggtttctccatggtggtcgggctggtctcaaactcaggtgatccacccacctcagcctcccaaagtgctgggattacaggcatgagccaccgctcccggctccttcgttccttttatcactcaaagtggtattacttaaggagtcaaatccgtagagacagaaagtagaatggtggttgctggggtggggtatggggcaaggggagttgtttaatgggtatgaagcttccatttgagaagatgaaaaagtactggagatgagtggtggtcatggttggatgacagcgtgaatatgcttaatgccactgaactgtgcacttaaaaatgattacagtggcaaatttcatgttatgtatattttaccacagttaaaaaaacaatggtattacttaaatcatttcataatatatggaagttgagagcagtgggtataaaaaaaataagcaattttttccttaagcgatggagcatagttgctccaggaaagaagtgggtgactgatgttactgaatcctggggcaaagcaaacccgcatcccatagaatgttattcccaaggagtgttctggacaatctaggtacaatgaggacagagaccaaacccttctttgtgcatcaggatgccctggggaaattttctacttacttttgaagaacaactcccaaaatagagaatttcggggaagggaagacagacttatttgttatcctctcttcatgacaaagtggatggaggataggaaaatcaaactaattgaaatccaaggctgggcggggtggctcacgcctgtaatcccagcactttgggaggctgaggcgggtggatcacgaggtcaggagagccagaccatcctggctaacacggtgaaaccccatctctactaaaaatacaaaaaaattagcctggtgtggtggcgggcgcctgtaatcccagctactcaggaggctgaggcaggagaatggcgtgagcccaggagcttgcagtgagccgagatcacgctactgcactccaaactgggcgacagagcgagaatccatctcaaaaaaaaaagaagaaatccaaagatgtttgaatttcttcactaaatattagccagaacctgatatgtaccacagtgatggagtgtggttggtacttaaaggaaaaagaactcaggaagaatccaggaagggggcagtcaccttatgatgatgaatgggttttgccaaacctctcagaatttgggcttttgttttctgaccattgtctcactgagttctctgatgaaagtcaaagctcgtaaaattacagtgtaggtgttaatctagcacagcagttctcaaagtgtggctgggggctggtagggattctcaaggtcttttctaggagcacccacaggatcaaaactgccttttttttttttttccaagacaggatctcactctgtcacccaggctagagtgcagtgacactatcttggctcactgcaacctctgtgccccaggctcaggtgatcctcccacctcagccacccgagtaactgtgactataggcacatgccatgatgcccagctaatttttctatttttaatagagatgtggttttgccatgttgcccaggctggtcttgaactccagggctcaagcaatccaccttccttggcctcccaaagtgctgggattacaggcgtgagccactgtgcctggccaaaactgttttcatgtaatattattttgaaattatttttattttttcgaggcagggtcttactatgttgcccaggctggtctcaaactcctggcttcaagccatcctccttccttagcctcccaaagtgctgggattataggcatcagccactgttcccagcctgttttcatggtaatattgaagtgacatttgcccttttcactcttattctctcacaaatgtatggtgaggttttccagggacatcattgtgtgtagtgacttcatcactctgacaactaatggaatgtgtgcttgcatattctgtgttttaaagatttctcagattataattcctaatttggtaaatatcaatagatataaccaaatcagaagttcttggggttcttaatcatttttgagaatgtgaaggaggtctgtaatctgagttcattgagctggcattatggccccactgtaaagatcatctcagagagcttagctgggttagagaaacccttctataaaatcagtggaaatgaacagaaactagaggacaatacagggagtaaaggtgaactattctgttctgcagtactggggccaaaagaatgttggttctgaagtgttagtaatttgagtaaaaccaatgggttgcagttttccacatttaataacaaacaaccagacagtgaatttgaagaacctcagcgaagaagatctgaatatctttgctgcttgcattgggatataaccttcaaccttgacgtagaacagggcttacctggatgggtctttacttgagacaggaacttgggtaaagctacagagttttttataagccatgtagatattgtggggatgaggggccttatccttccgcatgccatcctcattggggttttgatcacagatctgtatttcctgggatacctgagtgccctcggctttaacccaagttcagcttagcactcctgagtggtgagattctcaacttaagagggacggttgggccggaatccttgggtctgatttgctgtgggaaggggaggaggctaactgtcccatggacctggtcacagctgttccacatcataggtcttggcctcaccaggccttctctggtcagtgaaacaagtaggtatttgtcatgtacctgagcacggggcatactgactattgcttattgccatggcatccctggaagcacgctgcaactatttgggactgacggtatcgtaccttccctggtcctcttatcacattgtttccaaacgggggcaattttcaccccaggggatacttggcaatgtctggaaacatttttggtcttcaaaaatgtcagggttggggggtgggagtgggggtgcttactggtatctagtggagttccccttcctccttcattcctttctctgccccattgcctgccatgaacaacaggttcctggtagcctttgtgctatggttctgttgggaattggtgctctggcacattcctctctccatctgaggagtgtgaagagcctagatcttaaagctgaacagctgaggtgcaagtgatcgttctgttcagtaacagctgggttactttgggctgtttaacctctctgcctccgtttctccataccgcctctgtaaagtgaattctgataattaaaaaaagaataaagtggctgggtacagtggctcacacctataatcccagcactttgggaggcgagaggataacttgaagtcaggagttccagaccagcctgggcaacaagcgagaactcatttcaacaaaaaaacaaaaaaatagctgggcatggtggcacacactgtagtctcagctactcagaaggttaacatgggaggatcatttgagcccaggagttcaaggctgtagtgagctataatcacacaactgagagtgagaccctggctctttaaaaaaaaaaaaaaaaaaaaaaaagtatgacccaggcacggtggctcacgcctgtaatcctagcactttgggaggctgaggcgagcggatcacctgaggtcaggagtccgagacagcctggccaacatggtgaaatctcgtctctagtaaaaatacataaattagccgggcatggtggcgggcacctgtaatcccagctactcgggaggctgaggcaggagaatcgctggaatcagagaggcaaaggttgcagtgagccaagatcgcaccactgcattccagcctgggcgacagagcgagactccgtcaaaaaaaaaaaagtatgtaaagttcttggaatatgtgaatactcaacaaatatcactatcaatttctaaacatactgctaccaagcagatggaagtcccttttctaaggtgagcaagatgggtttcttgttgaggaggaagtttggaaagctcttcatatttattttaaggagcacttgggtagctatctcctacatttgattaaaaccggatgcaagcaagaaacttagtaaaggaaatcagatcagaaagaaaagattggcatgatgtaagtggaaaaactcagggaatacaagttttcttctaaggtcatatgtatgatttgaaagtcacaaaattttaatttgatgcttttcatctacaccacctaaatcttccatgaacctcttggttaaaaggctatattaagcacaatacttttaaaaaactagatcagagacatttttagctataaaaggctaactgaaaccattatttgagatccactgggaggcttaagagagttttgaagatagagtgagttaacagaacaaataatgtgtctgtcaagccaaggagcacaggcggctggccacctcccaggactgggggaagcctagctctagacactcctccctgccactgtccccatccattgaaccaggctcttgatgcaacaagggtcacaaatgaggctaaatcagagaactagagatggtatgactggccagctgaaaagcccatcaaaaatagctactgaagccgggtgcggtggctcatgcctgtaatcccaacactttgagaggcagaggtgggcggatcacttgaggtcaggagtttgaaaccagcctggccaacatggtgaaacctcatctctaataaaaatacaaaaaaaaaaaaaaaaaaaaattagccaggcatggtggtgggtgcctgtaatcccagctactcagaaggctgaggcaggagaattgcttgaacctgggaggtgggggttgcagtgagccaagatggtgccactgcacttcagcctgggcgacagaacaagactctgtctccaaaaaaaaagctattgaaaaaaaattagctgggcatggttagctacttgggaggctgaggtgggaggatcacttgaggctgcaatgagctatgattgtgccactgtactctagtctgggtgatagagcgagacccctgactctcaaagaaagctactgaacttgtctacctttgagaggccattttgaaggatagaggaagtaccagtatcgggtcagttggccagaatctctcattcctggagacaagcccaaaagtcccatctgctttttgttctcaaatagagaggcctcatatacatctggccatgcacatacgttatgccagccacaacagtgggcagtcactcgagtgcgttgcaggttgctggggctaccatgacagtgactgcacatgattggttttctgtctacgaagctcccagaaaacctggacatttctggagttccccctccctttcagtgtacttgtatagcacctgtgcaggagagcaccacacccctaacctcggtgacataaattctcactgaatgtagagacagaaggaaaggggacggcagagaaagcttgtctgtgagccttggtcacaagacctcagactgcagagacatgcaattacttttcttctgtcctttgtgtttccaaaagcaccatattttatttgataaaaggtacaggggaccattctgcttttgtgatgttgttttccaaatcaagcatcaggctctctggtctgagtaatgctttttgtgctgagtattaagtttgagacagtctaaacaattcctttgggggtactgaaatactttaaattttgcatcatttttgctagttataaaaataataaaagagtttcaacacattccatttgttctaagcactgttggattaaataaaattctggtcagcctgaagaacgtgggctatttcttgtgctatatataaaggtatgtggtctttactatttcacattaacctgttgctagaggttttcacaaatgtatcaattcacaaaagaacctcagagaaaagaatgtgaaatatgctaggaatttttgttaaccttggcttgatttttagaagttaaattttaaaatgttttagctttagaaggttcttttttcatttcttagtaaacatagtcattttcttggtgttttctaattttttaagttttaattgatgaaatcttaacatcttttagaacctaactgtaaaggtgtagttacaatttacaatttatagcatcaacttaatcttactatttcagttactgtattattccatttgcattactctaaggaatacctgagactgggaaatttataaagaaagaggttgaattgacttatggttctgcaaggtgtacaggaagtgtgttgccagcatctggttctagtgagggcctcaggaagcttacaatcaccacagaaggcaaagggggagctggtgtatcacacggcgagagtgggaatgagatgggggtgggatgcttctaggctggggtgcagtgatgcaaccatggcttactgcagcttcaacctcccgggatcaggcgatcctcccacctcagcctcctgagtagctgggactataggcacgcccaccacacccagctcatttttagattattttttgtagagagaaggtcttgttctgttgcccaggttggtcaccaactcctggcctcatgatcctcctgccttggcctcccaaagctttgcctttttttttttttttttttttttttttgagatggagtctcagtctgttgcccaggctggagtgcagtggcgcgatttcagctcactgcaagctccgcctcctgggttcacaccattctcctgcctcagcctcccgagtagctgggactacagatgcctgccaccacacccggctaatttttttgtatttttagtagagacagggtttcaccatgttaaccaggatggagctttacctatttttttaattggcgaatttttccttttattattgagtttattgagttatgagagttctttactctagacataagtcccttattagatacattatttgtaagtattttctcccattctgtgggatatcttttcactttcttgatgataacctttgcaacccaagattttttaaactttttttttttttttttgagatggagtctcgctctgttgcccaggctggagtgcagtggcatgatcttggctcactgcaacctccacctcctgtgttcaagcgattctcctgcctcagccttccgagtagctgggattataggcacacgccatcacgcccagctaatttttttatttttcagtagaggcggggtttcgccttgttggccaggctggtctcgaactcctgacctcaagtgatctgcccaccttggcctcccaaagtgctgggattacagtgagccaccgcgcccagccaaaagtttttaatcttgatgaagtctggtttatctatttttttctttggttgcttgtgctttttgtgtcatatctaagaaaccattggaaggcacattctgtcactgagatttgccagttgtccttactgtagtattttacatgggtcatatatttaaggtccttctgagattcctaaaaataattaattcccttttctcttcaaaagcttttaagttaatagagggtctagaagtgttcctctctcttcatcacttgtccttatcctgacctgccttaaagcatgatcccttgattttatctgggacatctgagccacaaaagtctctatatatatccattggcaagaggatggtagatccttatgtatgtcgatggtcaggattccttcaatttcagctcaatagcagagtggctggttaaaaatgtggaaagatgggagagccactgccaaatctcctcccatttttagctaatgatggttctggaagggactggcctgctatttcttacaattccagaaagtatccatgaatgtacatgctgctgctgaccagccttagggagggcctgatttcttatgggcttaaagttatagtccatcaaatctaagttagggcagataaaagacagcttatcaaaataaaggtacaagaggtgccattttgaaacctaatgctgtagaaaggatgtaggcaagtaacagctgtcagtaagcttcccacccctgctgcgctttcggtgtgtttgaaaagagaacaactccaagttccattttagaatgttaaagatctaaaaaatgtttccaaattaatttttctctcaaaggtttgctgatgcgcaccagactgtaaataattgccctaactgatggccaggcccttattctcagaaggggatataggtgtctttgtgggatgggtatccttaagcaggatctgtgctcctaagaacagcagcaacaggcagtgcagggaccttctgttgaattctacctgtaaaccacagcctgtctggaaggtctgactccaggccactcagccttggcaagcatgtacttccgaaagcgcctggcagaaatgggagctgatagacaggcgcacatggcagggggagatccttgtgcagtggcttgacactaactagaccagagaccatttcccatgttctttttcataacaccagaagcaccaaggaaagagaagaaaaaaattttgcacttatttttgggtcttttctatcacatgaaattcatctgaaacagttcaaattttgtttgatgttttagcaccccatttttcctgttataagatattcagtctctctgcagatataatgcaattggcttttatatcatgattatgtttttaaaaataaaataaatggagttgactaccacacagaagttttacttgggatggaaattgactcttcactaaaggtcaaaatagaatccatttgttttggctgggcgcagtggctcatgtctgtaatcccagcactttgggaggccaaggtgggcggatcacgagggcaggagatagagaccatcctggttaacacgatgaaactccatctctacttaaaaaaatacaaaaaaattagccaggcgtggtggcgggcgcctgtagtcccagctactcaggaggcaggagaatggcttgaacccgggaggtggagcttgcagtgagccgagatcgcgccactgcactccagtctgggtgacagagcaagactccgactcaaaaaaaaaaaaaaagaatccatttgatgtgcacgcatctcttaagaagtgactgaaggctcgtgcctgtaatcccaacactttgggaagtcaaggcaggaggattgcttgagctcaagagttggagaccagcctcggcaacatagtgagaccctgtctctacaaaacattaaaaaattagccagatgtggtggtgcatgcctgtggtcccagctactcgggaggctggagcgggaggcttgagcctgggaggtggaggctacagtgggtggtgatcctgctactccaacctgggtgacagagcaagaccctgtctcaaaaaaaaagaagtgactgaattacataaagctggatctcttaccagccccctgcataccccaatccctctgtctttgcttaggttgggctttcttttatgaataatagaaaataagaaaattgcctgttttgggcaatccaggtgtgtttcagagatttggagttaaaaagtcaagtaaatattttggcaacccaacaaaggtaagaaaagaagcatgcacctaacgggcttctcgaattacaggcttgtccaaacactgccttcctcaagagacgctggtcagggacaaagcctgccctgctgtcaacagcaaggcccggctgagaagtgggcttgcttctcttgctggtcctggccctgagccagataggacgccatttgactttgattcagtctgacccaagagaaaatataccatcagcaagtggaggatctttcctccttaacagactttagtcatattgcttcttcttccttgctgaaaaaaagcccaggtagatttttctctcccgttaaattggaaccctgaagttaggaggcacagtatctcagatactgtcagataacaagagccaccttttcagtctctgtaacttcatctatctcgagggttgggaggcagacagctatgaaagaagacccaaaagcagcagaatctgggcatcccaagtgtacccgaagcacgccagtctaggtggcccctctgtcacctggtttaagaacagacatcttagaaggaaggagctctgaccagctagtggcatgtctcctttcaagctgtgctttgtgtctcttcaacagaaaggcagacatcagagaactgcctctcttcctcgccctcccccagtggcttcccctggatcaccttggcagggcctcatcctgaggagggtgggtggaggagggaggagggcgggtggcggctgcagtggcggctcctttgatcacctcccgcccggttccagtccctgctgccagcaggccagccaaaggcccgactctactgatctgatgaggtgctgaataggacccgaagggcagggacagagcaagaagaaagcttcgggaatgaaaaggaaaccccgtgaacctgctcggcttcattggccggattttcctaccagggagccgctcagttcctgccagccagggactgcctgcccctcactctggcccctcttgtctccgcttttcagacctttgtgtgtgttttgtgtttgaatcacggctgctctccctggttctcaggctgggaacccactgcgcctgtttccatggtcactgggaagctcttagcgccatgtgcttcaaagggaacctttcccctcccagcactcgctgctgcctgccccagccaggctcacaataagcggctcctccaagccaggcctctgaccctcacttgccaggaggaaaaccttgcctttgccaagcaaggctgtgcagcctcacagaaatattcctcagcagagcatgtggatgcacacacacttgtggcacatcagtcctcacgtgcctacttgtagatttttatgagatatagagcttatagattggtgagagagtgttaactttcctcacatccctctgtttaggaacctttctgaaattgaagaaaagagcaaagcctaagccccttgtaggaaaagagatgagcttgtttggggtaggaggaaaggaggaagaagacccatgtcttttgggtcagcagagaatggaattgaagaacttagctctgggcttcctctccctgcagctggggtggtgagggtggtacctgttcactcttccagggccaaggatgcctgagcagttgcccaccaggcttgaaatttggctttgcttatttgttgaataatgcaggggaatgaagcctctcacatctgactggagagagtcagtggtctagtgatcttggagggctgctacatgatgacactggaattaaaaggtgactgtcaggccaggcgaggtgggcggatcacctgaggtcgggagttcaagaccagcctgaccaacatggagaaaccccgtctctactaacaatacaaaattagctgggcgtggtggtgcatgcctataatctcagctatcgggaggctgaggcaggagaatcgcttgaaccctggaggcagaggttgcagtgagctgagattgcgccattgcactccagcctgggcaacaagagtgaaactctgtctcaaaaaaaaaaaaagactgtcctctgaagagcttatgttttagatgcaaagcctgctcccctagcttggagctcacaatattaatatctgccttgggcttattgcactatatagagcctgtatgggaaattggacatttctccagtattaccagtgatcaaggttcttatcatccgtttctttttttttttttttttttgagacagttttgttcttcttgtccaggctaccgtgcaatggcacaatctcggctcaccgcaacctccacctcccgggttaaagcgattctcctgcctcagcctcctgagtagctggacttacaggcgtgtaccgccacgcctggctacttttgtatttttagtagagatggggtttcaccatttggtcaggctggtctcgaactcctgacctcaggtgatctgcctgcctcgtcctccgaaagtgctgggattacaggtgtgagccaccgcacctggcccagttgggctcttttgactcctgatattgtctttccttatcgttcctggttccttatcagtctccaggctggctgctgttggagtgtgggtggccccctgcagaagacactctcagtagttgtgctccatggctttctgtgtagtgatgggaatttcagggccatttcagatgtgccctttgtattactagaataaagtgcacctatttggtattaactctaatttctacttgtaactcatgattctggaaaaggtttctaaaacttgcagacttgaagcttccatcattgtaccaaaatctgtcttctctggccacatgtagcattttaagggtaggttttgataaagtcttagcccaggagccgcagcatcccaaagatgcttttctgttagaacatgcatacacagacctaaaagttagtacatttggcatgcctgtgaaaagcaaactgaagaagaatgctggctaccataaaacaggtgtcatgattgcattcctactgtatgccaggtgttttcacacattatctgaaatccttacagtatccccggagagaattgttatcagatgatcattttgctgctaatgcagggaggaggggacagaacgacttgaataacgtgtgtggtcatgcagctggtctgggcagaggtgggtgggagcaaaggcccctggctctaatgaatggtcttcacaggggtacctaccagtggttttgggattactttgaacagattctagggggaaagtttggttaaatttaggtaactggtttctcatcatttgggtacttgggaacctaataagtggacaaaacgtcccactgaaattatcttgttcacgtcatgcacggtggctcatacctgtaatcccagcactttgggaagccaaggcaggggaatcgcttaaggccaggagttcaagaccagcctgggaaacatggcgagacccccatctctacaaatttttttttttttaaactagctgggcctggtggcacccacttatagtgcagctactcaggaggctgagacaagaggatcgtttgaggctgcagtgagctgagctgtgatcgcaccattgcactccagcctggggtgacaagacctcatctctagaaaacaaatctctcctatagcttttaatttgctcctgatcgttcccttttgtaatatttttatcatagctcccctttttcttttatcagtttgcccctttcatagaaattccatttcttccttttttttttttttttttttttgagacagagtttcactctgttgcccaggctggagtgcaatggtgcgatctcggctcaccacaacctccgcctcccaggttcaagcaattctcctgcctcagcctcccaagtagctaggattacaggcgtgcacaaccatgcctggctaattttgtatttttagtagagatggggtttctccatgttggtcaggctggtctcgaactcccaatctcaggtgatccacccacctcggcctcccaaagtgctgggattacaggcatgagccacggcgcccggctcagaaattctatttctttcctttttgcaaagttacctgaaattgtacctctctcatttgtatgctcaatgaggaaggaaataagagagggtggcacaattaatctgtgttcaaaaatgtcatcatcactgtgtctcgtttgataagcagattgtattcttactagtgagagtagaagatcctgaatagttcagagtctggccagggcaccacaaccacacatttcagagcactgggccatggctgtggattcccccgaggaacgagtttgctgatgaccctgtttgtgctctccctgagggtgatggtttcacttattccatgctctgagccaactctcctaagattcttttatctaacatggcctgcagaagttaatggtggcatgatttactttgactattttagatgccaggcgtgtgtcttgaagagaccagtgaagaggggcttgaagttctgattcactcgaacttttttgggttttatgtctttcctttctcgtcagcatcaaggccatctaacttcaaggctgaatgaatgagttctgttttccttaatagggagagggaggagatggcctaggactcattcacagctgtgtgtgtggaaagtgcattggtgatagatcttgacttatttagtgatttttcagaagattgttggtttttcactggtaagaccaacaactatccttgttaaccagctttaaccagaaggactaaggaagttggacatctcgtaccactcgcaattgattttctaatgcagttctcttgtttaaattctgtggctgtgataatctaggtagccaattactcttttttgttaactaagaagatttatactgctgttgtgctagggtttgtaatttaaggtgtggacatgtccaggatgttaaatttagcttgtgtctcaaaactagagctatccaaactcttttttgctctggttgccctggtcccttgatgttcagcaagcagctttgcagtgcccacagcactccggcctccctccttggtactgcagggccactgtgaagagggaatcaggacaggatccttcaggtcttggcttaggcatctttttttcctaaaagtctttctggaccaatagtctgtcagcagggacggcttcacagaagagatgaaactcaacttttaagactggctgggtttgggggagggaagagaccaagaaggaaattccagcagtggggctggcaggagcagaaataacatgtggcgtatcccagagccagtcaaaaagagcaacttgactgggcgtgatggttttagcaggcaggagaaggtccccttgataaggaaggcatttccagggagtgcatcaagaggcatgcagaataatctgtcataagagtagagtttaaaaaaataaattcaaaaaaagaggcatgcagaagagtagtgcgcggtggagggagggaacaggatgtgcttaggcctagaaatagattgccattctggtcatttccatgatattgctgtgtattactgttctgtggcaatttaagtaaaagagaggaataaaactttgtaatgtattagagaccttaaaacttaaaatccaagaagatttttatatacctgaattaaaaagtgggacttggtagaagttacccaggaaacataaaaaaatgaacagccttctcatttccccacttctgtggtcctaattctttgaccttgaatcttctctctctctttaaaatggtggtaactatatacatcatataagcttcaccattaagtgtacgagttcagtggcattaattaagcacattcactctgctgtgcacccatcatcactgaccatctccagaactttttcctctttttttttttttttttttgagacagtgtctcgctctgtttcccaggctggagtccagtggctcaatctcggctcactgcaagctccgcctcctgggttcatgccattctcctgcctcagcctcccgagtagctgggactacaggcatctgccaccacgcctggctaatttttttttgtatttttagtagagatggggtttcaccgtgtctgccaggatggtctcgatctcctgacctcgtgatccacccgcctcggccgcccaaagtgctgggattacagacatgagccaccgcacccagcccctcttcttaaactgaaactccatacctattaaacccaggctcctcacttctgcctccccacagcccctggcaaccaccattccactttctgtctctaggaatttgaccactccaggtcttttgtgagtggagtcgtgtatttgtccttttgtgactggcttctttcacgtggcataatgccttcaaggttcgctcttgttgtagcatgtatcagaattttattcctttttatgatggaattatatatatcccattgtatctacataccacgttttggttattcattcatctatctatggacacttaggttgtttccaccttttgattactgtaaataatgctaccatatatattctgtatattgatcccttacctgatatacatgaaatagtctttctcatcctgtggcttgccttttcatcctattgatagtatcctttgatacacaaaagttttttctcatttttgtttgtttgtttgagacagagtctcactctgcacccaggctggagtgcaatgctaccatctcaactcactgcaacctccgcctcccaggttcaagcagttcttgtgcttcaacctcccaagtagctgggattacaggtgtccaccaccatgcccaactaatttttctatttttagtagagatgggtttcatcctgttggccaggctgatctccaactgctgacctcaagtgatccacccgcctcagcctcccagagtgctgggattacaggcatgagccaccatgcctggccaaaagttttgactcttaatgaagcccactttatccattttttctttcgtcacctgtgctttcggtgtctcttctctttttttgtgcttgctctttaattcatcttcatctaccttttttttgttttaaacacatagaaggttacacaaacatatcttcctactcagccttggtttataatttactgttgccctaagaatttcagaaaggaaaagaattcttgcttccctggctaggctcttggggtcttgatgtgcaagaagaaatgctgttgtgaatacaaagaatgatgaggaagtatacaaaaggtgccctaggctggctgcgggggtccagcaggctggctacattattctgtggtcaacctcttacaaatggggtgctcctgtccgtctccgtggccagctgccaccagccctatggtgtgaatggcaaggaagtggggactggcggctggccgaactccaggatgcagccttggctggcagagaaccaaaggcagagggggaaaaacactcttgagtatgagagaaataatgctagctccgaaacctataattcgcaagtttaaaaaaatttaaaaaataaaaaagatttttcaaccaaactgtgcttttatctttaggttctgaatgggagattgttcacacagctaagctggctgcagaagctaggccagttaaaacaatatgcaggcagctctcctctaagtaaccagaaactgttggctcaaaggagcctgaaccgaggaaccaacctgctgggagacgttttccaagtaactccaagcaacagcctgaatgtaaatcctcccgctggggaatggcactttggcaaatgaagaccctaattagagatggaagggtttctattttgtttttctttaatccttaccctggggcctttgcagggccaccatgtctctgcttgtgtgcaaagaaatttccagcttctctttgtaacaagatcctcttttgggaaagaagcaacaagccgacaatgtgggcccaccacagccgggggaccctgcaaccagcctaatccaaaacaaaaaggcctggtctgggccggagcagctgggtcacctggattggccaagtcgtttgaagttgctagccaagttggatcttatgttgcccctgccccgtgagacactcaaatccgtgcttagagtgcaagtgaagtttcttaacttccaaaggagaacagcagtgtgaacaaaatgcaaagcagtaagagagaactgtagctctgaggcactagggccaaggtccaattgaatgggtgtggagccctcttatctcctcagccttctatttgggtcttcactattggatctaaacagtgaagcagagggactatgctctctttcaaattgatcaccttagttctcaaaacatccagaagtatcacatacgtggagaacctgcccacgccagtgttgttttgttgtgggtgcaccattgacttacccagtattctcaaggtcttcgaactgatgattctgctcaatttcatttctctttggccctggaaaggcagttgagtagagctctctgggaccaaagtatcaagctggtcagtgaatgatacaatcaattttagatagttgtggataactgaagtgaaaacaaagacatacctttcagcatcctttacactggtaggtgtaggaagggcccccatcgagggccgttaacttacttgttaaattcgcagcttactacaggatgcttgtgtctaagtgatttcaacttctgaaggggaattacacattttttagtcttaacataggaaggatgcttctccctaaccacgactccatgctgagtctcaggctgggctctgtccagatagaatcatctttaatatttacaactctgtgatctggttggtaccctgctttaaagatgaatacattgagactcaggggaaggggctaagctacagacatcagccatggctccgtcccaggttagctccagacctcctgctcttctcatcagttctgtcctttgagttacttaagcgtatagatggtagttgatacagttctgcataacagactgataggttcctgaccaacagtctgctcctaccccctcttttttgggaagccgagtgctgttgaagagccacccattcctggttgccacatggtagacaaatatgtctgctgcatttacttcccagaagtcctcagcttgctcatgctgtctaaagttagctttcagggaatcccaagatgtttctttttcagctctctgcttgtggtcaggctgcttcaacttggagaaaaacggcccattctgttagctgtcgggcaaaatgatgactgtgaagagtatcccttccatgctagtaacttcccctgttccaacttctcagtttaattttcagtgaagcttctagaaaccacttaaagtcattgggaaacaggtacatcaaggactaaaaagaaaactggttttgtagatgcaacattgatccctctaaaaagataaggcaagacgacaccttgcccttttgtctttgattttattccttggctccttggaacatgtgctgattaaatggcaaaatatgatggcaatttttaccctttgttattattgaaaatctttgccaagttacagttacagctaatttaaagctgtatccaaccaaaatggtgttaagagagggtccctgataatttggatgtcaacttgcacttgtacctaatgaacagcttgactcattcctggctaaatttatgacagtggctttggaaggggactcagatatcaagaaccagattctatcacagatttttagattacttgtataggccataaaagcgtgatgatatggagtaaattgaataatactggatttttggcattgctgcttcattagcatgaggcactggatggggcaggcgtggaggcctggttaggctgggcgcaatgctctaacataagcaaccatgggcctcacagaatattggtggtagcctttcccaggatggtcttgcattgctaataatgctaaaaatgtctgtgttcagagaaaaacattatgaaagtcttaatagtctcaatattatcccctaaatagcttttccctggatttttttcatctgtcctggtcgtttctgtgtcattgctgtaaagtcacacagccaaagtcacacagccattccgagtattgcagtgacaacagcaaggatcccagccaaaatcttgtcctcaggaagagctgagacatgttactctaattatcactgatggttttattgctttggggtcatgtctcaccccttaccccctcacttagtggcatatttgatgttgttcagtcatctgaagtcactcatttatcccctgaatgtccccactggttcccccagtggcagcagtcccccggcctgcaggagttgtagtgcaggcttgggtgatgtgattcctgatgtaggtgagacccctgaaccaagagcagttcagcagctgcagctgctcagaagctaggcttacacaccatctccctgccgctccgtgtttgacagaaagcagagatgcttcagcctcctagctgcacttaaaggtagcctggatgcagtgagcttgactaagtatctcccttttgtagctcagtgtaaaatacagactctgtttttggaattcattcatatgtttattaagcactgcctgtatcccaggcagtgtgctagacgctgcagatacagtacttattaaagtagacaagttcactgcccccatggggctcctggtcagtagaggagacacagagacaactagcagcaagtaaacacaaagacaacaaacagggcaactgcagattgtgatgcagctgcaaggccaacaaactgggtgagtggggcttttctctgcataggctgcctcgagccaagagctcagagtcaaggttcctgaaagaagagagggaaagattcccacagcccactccccacatcagagcttgcctgcctccgctccgtcatctgttctttgacacatctgcaacctggggtgtgctctgatgcttcctgtcattctgtcactttctaacccatcaaacagcactttgctaccatataagtattagtatctgcctcctgtctgctaagaaataaaatgaaggcactcaagtcttacagaaagttagctcctttattttaggtatctcgttaaatattctctacttgattattatgtgacagttgcttttaaatcctctgaaagttgcataatatgctatgtgatacgaaaggatgtatatataaaacctttatttttctaataattgcctataacttaccagtttgaattgttttaacgcttattgtagcctaagaagtccaaagtttaattgaaatccagttttgttttttggctttgggttaatattcttccttccaggctgggcacggtggctcatgcctataatcccaacactttgggaggccaaggtgggcagatcacctgaggtcaggagttcaagaccagcctggccaacatggcgaaaccctgtctctactaaaaatacaaaaattacccaggcatggtggtgcacgcctgtagtcccagctactcaggaggctgaggtgggaggatcacttgaacctgggaggcagaggttccagtgagctgagactgcaccactgcactcccgcctgggtgacagagtgagattctgtttaaaaaaaaaaaaaaaaaaatccttccagacttctttccctctcccgtggttttaggaagggaaggacagctgggcatgatggcttaaccctgtaatcccagcagtttgggaggccgaggcgggtggatcacctgaggtctggagttcgagagcagcctgaccaacatggtgaaaccccgtctctactaaaatataaaattagctgggcgtggtggcacatgcctgtaatcccagctactcaggaggctgaggaaggagaatcgcttgaacccaggaggctgaggttgcggtgagccaagatcacgccattgcactccagcctgggcaacaagagtgaaactgtctcaaaaaaaaaaaaaaacaaaaaaactgaaactggcttggctgatgaaagttgtatcttatactgtgaactgaataatgttgcaagagattaagtgatcattactaaatgatgcccctggtactagtgaaggttgttgtcatagttcatgcagacctgcacagtgtatcgacctcatgttcacatgaagatctagatacctgatcaacgaagtgtccactcagcccctgtcaggtgcattctgggaggtgaagtggtatgtgactgccttgaaggaaggtgaaagcctagagacagattgtaatggtttagaactttctctttagaaaatagtgaataaggaaacaaggctttgctggggcagggggtgggagctctggcaaataagaggttcttctagaacccacttcctttgttctactaagtaaagtcttgctaacgctgaataattatagtcaagaaagcctgaatgaggccatccttttacttgttcaataaaggttaatttaaggacccaatgggacttgagatagagcttgaatttagggatttttgcaaattacctgttaaagccatgaaaacagaagtgtatttgttccttaatatgtgcatgacctcttactatttaagagtgattactgattaaccagggagtttcaaaggagatgttttcatattcagatttaaagaagttgctccagctcagagaactggcttctgttggagtgagctatgaacagagtagggctgctctatctcagagcattgttcattcacctggagaaacttccttcctgtgtcaagcacctgtagcatgctaggggttgtgcctgcccagtggtgcactaaagccacctctgcaatgttttcatccaagaaacatgaagtaggaaggaaaagtaacacttgcctagaaaggaaagttgtctgctccctatattctctatgaaattgagacagctattctttgcccccacaaatggcctttaggacagaaccattgagtgtcaaagacaggcccagcctctggagtatacttgtctatttccatttccaaaggtgagatgttttccaggcagagctctgtcagttttatgaaagccaaaaatgcattagccacacagggtacacttgtgcagtattttaagtgtaacttggttgccaacacttgaattggaaggtttaatataaaaatccacatttctaccttctcttgaaaaatcagaaggtctggcagtgctggtgtcccatttctcctggtaaaggaagccccagctgcctagaagttgcccccatcaggcaggtgtacactgtccagtctgccacggcgcctgccactctctgctgtcctcacactgcagcagcacatccattgccgtaaatcttaagtgtggcccctgtggacaattgagtttgcaatctgtgttgtgtgatttttaaattgcagggaggaagatcatccaggctgtctgtggaaagttgagcaaatcaagtgtgaacgcagaccaataatttctgacagtcaaaccataaatatgaagagggaccacagagaagctggattagcagacttgtatactctgattttgtcaagcactggaagaccaatttagggtgaccatatcatttgtcatccaagctgagacgcttttgagaatggaaggggttatggtgggaggagaaatgtaaactggggctgtcctgggcatgctaggacagaaactgtggacaccctaggcctgtgaatgggacatggaaacagaaagcttatatccgtcaaccaggatgagtgcagaaaagactcataagaggagctcacatagaggctacgctggtatagaaattgttctagaaaaattgggcaagattttgcagagaaaggaggcttttagatgtgtccttaagcattgaagcgctttgagaggtaatcaagggtccaggacagcagttgaggtaacatgaataacctatgcaacagctggaagatgtgcgtatgccttaacttttcagaaatgggggaactgtgtgggtggagcatctggtgcttggagggcagatagtgtgggaggggagggcggacgggcagaccggatccaaactggatccaaaggagagtcttgaacattataaggaattgagacttgaatctgagaaggatgagaagacagctcagggcatcatgtatggaatgaactggaaaaagattggagacagagaaactgctgcattacagggtagcagggatgcaaagggagagcccacttgaaaatgattctttatggagattggatgtggagagaggaaggggaaggggtagtgagagaagaggaggaagatttgggtttctagatttgtatgatggtgattcccttaacctgagacaagtaatgtaggtttgggagaaacttggtgactttgactttgatcaggactagagccctgactctgactttgaactggagccctttgaactctagccctgaaaagggtcagggctagagatgaaggttgagaagtcattagataggggagtgtgtattcaaaccaggagtccagaatgagcttgtccagaaaagagtatagactaggaagagagaaggggtacagcataggacttaaaggaaaacaagtaagtgagttgggaccatgtaagagtcagtgaagggaacccgaagacctcagagagaagaaaacagaaataggctgaggagcacaaagcaatgtaaacaggttggtagagtagcaatagtacagatgacaacacgggtgaggtagcatggccctgtgcattcatttagcacaggtgtatcagttagcttttgctgcataacaaactgcccttaaaacatagcaccctaaaaacaacagtcattttcattgctcatgattctgtgggttagctgagcagttgttctggtctgtgccagcttggctgatctctgtggtcagctagtggttcctctgggactgagtgatctaggatggcctcactcaagtgtttggggcctcacctgggatagccatgccctctcaacatgtggtctcttatcatccagtagactagcccaggcttcttacatgatagttctcagggttcccagccgcaagagagggcaagcatgaacacccatgaactattcgatcccctcaagcattttccaagcttctgctggcattgtatttgctcatgtcccattgaccaaagcaactcatgtggccaagcccaaattcaaggggtggaaaaataagctcaatttcttgatgggaggaatcataaaatattgtggccattttctttactctaagaggtgtgaatgtcttgtaacacttggcaggagatatttgattctttgtgtcaatcatgtatcttccttctagttgagctagtaaagattgaagattacaacagaacaacttaaattctgaagacccatttaattgtgattattttaattctgttcccatatgaaagctgaaggtagtacagggaaaaacagtaccacttgcattcatgacatgaagctaaagcgattactaaagaaattgataatacccagttcaaaactcaaacacaggtcccctctgtcaaagcagtactgtctgatttgcagcaattaacatcttagtgccatgttatttaagactagatcaatgattagcaatcattaattggcacctaccatgtacccaaactacaccaagcactttacacccatgaactatttaatcctctcaacaaccctataaagtacaatcactgtcttagttctacagatgaggaaactagggatcaaatattaagtgtcttgcccgaggatatcagtaagtgtgatagaaccagaaataggaaatagggatttccctcaggccactgggctcccctgactgtaggcagcattagcaagtatgcaccccaccccacccccatcttgattatccttatcttgatgaaatatagttgtcccctcacatttgtgggaaattggttgcaagacctcccccccaatccccccatggataccaaaagccacagatgctcaagtaccttatataaaatggcggtagtatttgcatataacctatgcacatcctcccgtatactttaaatcatctctgattactttatgatacctaatacaatgtaagtactatgtattaataaatagttgttataatgcatggttcagggaataaatgacaaggaaaaaaagtcatgttcagtacagacacaaccatccttttttttttttttttttttttttcccccaagacagagttttgctttgtcacccaggctggagtgcagtggcataatctcggctcactgcaacttctgcctcctgggttcaagcaattcttgtgcctcagcctcctgagtagctgggactacaggtgcatgccaccatgcccagctgattttttgtattttagtacagacgggctttcaccatgctgcccaggctggtcttaaactcctagactcaggcaatccatccgcctcggactcccaaagtggtaggattacaggtgtgagccaccgtgcctggccgcaaccatcctttttcttttccgagtatttttcatccgtggttggttgaatgcacggatgtgaaacccactgataaggagggccgactgtatactcacatctactgacctggggtctgcctgcctcccagagtccaggtgggctctgttctgctggtctaacttacccattcatccagatttcattgagaggggctttgtttttgtgtgtgtgtgggtgtgtgtgtgtgtgtgtgtgtgtgtgtgtgtgtgtttgagacagagtctcgctctgttgcccaggctggagtgcagtggggcgatcttggctcactgcaagctccacttcctgggtttacgccattctcctgcctcagcctcctgagtagctaggattacaggcacccaccaccacgcctggctgattttttgtatttttagtagagatggggtttcaccgtgttagccaggatggtctctatctcttgagcttgtgatccgcccacctcggccttccaaagtgctgggattacaggcgtgagccactgcactcggcctgttttaaaaatactgtaatcccggctactcagaaggctgagggaggagaatcacttgaacccaggaggcggaggttgcaatgagccaaggttgtgccatcgcactccagctggggaaacgagcgaaactctgtctcaaaaaaaataaataaataaataaataaaaataaaataaaatactgagccagttttagtagatagcagaaggaggtattatgttgctcgatctgcataatttttaaaactggctttggaattttcctatattaactaaaattaaatgcattcacatggtgaaaggttgtctgtgtcaaaatagttttgctttgaagtaataagaggcaataatggaaaaagaatagttgcagattctcccctcactccttgttttaatcttttttttttttttggagacagagtctcgttctgtcccccaggctggagtgcagtggcgagatctcggctcactgcaacctccgcctcccaggttctagagattcttctacctcagcctcccaagtagctgggattacaggcacgcgccaccatgcccggctaatttttgtatatttagtagaggcggggtttcaccatgttggctaggctggtctcgaactcctgacctcaaatgacccacccacctcgacctcccaaagtgctgggattacaggcgtaagccaccgtgcccggccttgttttaatctttattgaagtataatagacatgtgataaacagcacatatttaaagtgcacaatttgttaaggtttgacctatatgcacacacacatacacacacacacatgcacacacacacacccattaaaccatcaccacaatcaagatgaacatatatgtcactccccccacattccctcaattcccctttaaaatccctccctccctttcctggcttccctgccaaacaccagacaactactgatctgctttctcctactgtagacaagtttgcattttatagaatttaacacgaatggaatcatgcagtatatactgcttattctggcctctttgacgcagcataattattttgagatacattcatgtggattgtgtataacagtagttcatttctttttattactttttaagaaaagagaacgctgctttttttactctgaacttgggccaggatgattgaagttacctacgaattgtacattaaccaactaatggcagtgaagagttaatctgtaacttcatctgttagctgttaacgtgacccccaaacctaacctcctcttgactgtcagatcctgatcccagacacactttctctaaaggctaaaactgaagtaggactggagacttggggagcctggtatttctgagtcttggttggtccctgcccatcactggatcttggtgtagcatggtctcatgatagtgtgagaacagggttaggtatgtgactgtgtgaccagcagtactctgttaaaaaccttgactttaaattacttcatgaagtttcagatgggggaaaaagaacccacaaccctgacttttgtcagctgtccgtcttacaagtctgagttacgcagatgtcctaatccttttagaagcaatctcagtaggttggagaatttattgttgttacagatactcactttaaaatgtattaagtgaactcaattggtatatttgaaaatactttaatttacccttcttttcaagattccatctcccttataagctaccatacacttgcctgctagcaggtcctttatagtcaacttccctgtaacaaatgagagttttttgggtataaatgtatggggtacaagtataatttggttacatgggtatattgcatagtggaaaagtcagggcttttagtgtagccattacctgaattatgtatattgtacccattaagtaatttctcatcgtccacccccctcccacctccaacaaattggtttttaaaaaattctttccttaaatgcttggcttcaaatttcctggtacaggaattctgtaattctgataaaaaattgcttgaaataatacacaaaatgtctatgtgtttactaatagatcctgattaaagttattattgagaaactaacattggagtcctctaaattctgatttcccagaaaacaaaaaatcttcaatattataaaacttaatggactctacagaagtcggggcagggttgacaggaagcagttggctctgatggaacaccctcccccgctgccagcacactctgacctcaggaaagtcatgcctcctttgcaaatcttggacatgggactaggtgtgctttcatcccactccaggactgagggacacttgattcagatagaccatagtcaaggtccatgttgcctaagagaccctctttgtcccccagcatgaggactgcagtgactttcaagtggctcccaggagtggagaagcaggctgcttcccttgcatgggatccattaactcccaggcatggagaagcaggctcagttccctacggtgggctatattagctcccacaaatggagaagcaggctcagtctctccttgggtgtgctgcattgtctcccaggaatagagaagtaggatcagtcatttattccatgtggggctgtctggccagaactcttccctccaaagggagtggtttgtggtccctcttctggatttggctcatcagtctttccaaatgtcccagccacctggtaggtatgcagtttgatttgtttagcccccaaatgccagccagttccccatgcctgcctgatagctgggtgcctcttgagccaatgtcggcatattctacaattacctgcttatttgtgggggttacatagtgcttgtagttatagctctctccacttacccacaaaccagactgccaaactcctggatcataaaacaaagtgtaagcaccctggatcatgacccagctcttttcctgttcttcttttgagactttcctaacaggaaaggctctgggtaattgatagagattatccctgattcccttaatgtaacctttttactctttccttttcctgggattaagctgttcttttgcaagaagtccttttcttaatgacagtcattcacctgttattgaccaaaggaagcgatccggcccaactccacctttctgtggttcagtctctcgagtctctttcattataatgactttcaaaggcattaactgtttttttttttttgctttcaattttctgcactgttaaaggctgtcaaactatactttaatctgccttcctgaaacaataattgcccctgtatttgttggtgaatatgagtgttaatattgagtagatgttttaatatttgctgagggttcccaggcagcgtgcgttgctactgaggtctgctgttcacaagataacaagttgatataaagtggagacacataggctcagtcagcagtgcctttcttcttcttgcagtcctgtgatatttctcttcttcagggcacttacctctcactgtgcatgtagggtccctagtataactactagaacaccatgagaagaggcactagatcttttaggactaggttcttttggcatatgattgtaccttcatggtatatgctcaataagtatttgttaaattaatgaatattttgtctggaagcacattgccacaggactgggccttggtgtagggattagggaaccccttccagaaaaaataaaatttcaggtagtgacccaaaaatgtcagtaaaccatagtgactgcttggatgctgtgttccagaaactaaactgtgggcatgccagctgccaccaacagaaagggtaatcactaaatagttgttaagtttatacaatggccatgtgagtggataataatacccaaccatgcaaccctgtgctacttttttttttttttttttttttgaagacagaatctcgctctgtcgcccaggctggagtgcagtggtgccatcttcgctcactacaacctccacatcccaggttcaagcaattctcctgcctcagcctcctgaatagctgggattacaggtgcccaccaccacacctggctaatttttgtatttttagtagagacggggtttcaccatgttggccaggctgatctcgaactcctgacctcaagtgatccacccgcctcggcctcccaaagtgctgggattacagatgtgagccaccatacccagcctctatgccaccttttgctaacctctcccctatacttggtgtgtctgctgcctccaccagcacctttgatatccagctgctggctggccttctcttcctcttcattctggcagcttggcctccatgaagtctttcctgaccacaccagcctatggcacacatcacccccatccaggatgctccattgcagaagtgtattgagcatccttcaaaataatcccacccaattaaactcttaatccatttgtttcccttgttggtctagttccatttctctttctttcttttttttttttgagacggagtcttgctctgtcacccagcctggaatacaagcgcatgatctaggctcacggcagcctcctgagtacctgggattacaggtgcaggccaacatgcccggctaattttttgtatttttagtagagacggggtttcaccatattggccaggctggtctcaaactccggaccgcaggtgatctgcctgcctcagcctcccaaagtgctgggattataggcatgagccaccgcgtccagcctctagttccatttctttaacctagtggattgcaagcccctcactgctttccagcccgaaaggggcattgatgggattgtgaacacaggacagaaagtagtattaatgattattgttacaccccggatgcgtggtagggatgcttgggagcacctttattctccagctagcattagctgtcgggctgaggaaggctagcttgatgactctgccacttttctccttccccctccatcatcagcaccattgtgatgactatttattgagtaccaggactggaacgcatttgggagaaataaaagcatagatttgacacagccttcattctgttagcctatggaaaggtgattatagcacttgttacttgaattagacccgaaaatatagcacattttagggtctaattcaatataggacactctgcgtttaacttatgttttacagcctaactcatgactgctatggccaatatcccttctccacacccccagaccccatcactaaaattccttctagtggcagaaccgtcaccacttatcacagataagtggatattagttgggcagttgacatacaagttctgtgacttggttagctcagttcagagtatgtttgagggcttacttcaagaaagcatgtgtttcattttttaaaaataggtcttaaacctgaaaatggtgtccttgagattctcatcgttctctatttttatcctgttatcgcagaagacccatctggaacttgcattccattgctgtctcctactcaaggcagaggctcctatgcaagaccctgggactcctgtggcatggaggccaaaggcctggacccaaaagtcaggaggacttctgccacaaaccccaaaagcttgccccgtataaatggttgctcttgtgcccatggctgtgtccacccagcatttttgtgcctgctgggttccaggtgccatgccaagacctggtgaccagaggatgtctgtgatcattgttgtttggaggcttttgattgtgagggacccagacttctgctttgggggtatctttccccagacatcacaaaaagctcaattgtttattgcctcgaagacacattttctcttcaacaagcgctttccttaagtctgaggtagagtagcataagtgggtttcttgaaaaccagaaatgtagctgagaaagcagttgggccattctaggagggaaagaacaagggcttgatgagttaggttaagaagcacattcccagctcaccatctctccctctcttacctccttagcatcttggtctgtggttacgcatcttggctgcacctaagagttggcctgaggagctttcaaacctacaaaggctagatctacctccagcccggttcccattagtcaatctccaggaaggagtctacccctctattttttatttaattttatttatttatttatttatttttgagatgaagtctcactcttgtcccccaggctggagtgcaatggcgcgatcttggctcactgcaacctccgcctcccgggttcaagtgattctcctgcctcagcctcccgagtagttgggattacaggtgcctgccaccatgcccagctaatttttgtatttgtagtagagacggggtttcaccatgttggccaggctggtctcgaactcctgacctcaggttatctgcccgcctcggcctcttgaagtgctgggattacaggcgtgagccaccatgcctggccccctctattatttaataagctcccccaggcattccgacataccactgggctgacagccactgaccaccctctgccagactcatgctgtgtcatcatttcttggcctaaactgggacgtccctgcatgtatatgaagtgtaacatggtcatgtcaacttccagaagccttcaggagatagattcagtgtcatccccattgtgcagatgaaataaaacagaaaattcatcacatgctcacagtcacagagctgggaaggtgagctaggatttcagtccaagcagtgtgagatacccccttttcttcctgctcttccactatagcagtgctaaaaagagcctgggttggccagcctggctttggtagggtgtcatcaaactgactgcacccagataagaataacatggctgaggggggccatgtaactgcccttctctagagaaagggatttgattctgtagctgttataaatgattttggtttaaggtgaagagataatgaaattttcttaaactctactaatacaaaatcacgtaaaaggagtcaatatcatagggtacacaggggaccattttgaaacaacttagatccttaagaataaaggatgaaagttgtagtgtttgtgaacttgcattggctacaatggcaatgaatataacgcctttggatgaaatagtctttgactaaataggcctgagtttttaagcaggtaaccctgtacaaaagtaggaaaatgttccaccctgccacctctcagggagggccagatgtgatgcaatgagtgtgataggcagcaaggggagaaaaaaaatccctccttatgttgactacatgagctgcacgacatttgtaaagggaaatttcaagagaagggagaccaagtgggttaggataagagctatctggaatttccttgtgttaccaggaaatataatacttacataagctattaatggaatatttggaggttcagcattcacattgatatatgtgtacgtatctccattacacttgattttagaaccccctgggacaacatgagtatttctctggcctgggattatggagagaggcttaggtcaaatgtcagctctccactttgtggctgagtatccatgggcaagttacgtaacctttgagcctccagctgtaaaatggggatcaacaccacctcccttgcagagttgctctgcagattcagtatcatttgaaagcactcggtgccttgcctggaacattaataggtactttccttactttccctcttggagtctcagtaccactctatgaccaagcaggggggccgtgctttaaggcccctcttttaaaccttctggccacagggtgaggagtccaaggggaagcccctgtccaaaccattcccagcatccctaaactcccctaagatgaccttgtgttggtttctagcccttacagacctctcttctaggaccatcctcctggaggcacagtgcactggcagcatgcccctcttcccaaggatgtagacacagcttggcctcaaagcctagggtgttcacctgcctgtgtacaaccccctcaaagtgcagggtggaccaggggtcagctgtctccacactgacatgctctggcaaggagctccaaggagttggaaagctcacctggaacctatgtttcaagttcttatgaaggtacatatgtcaagatagaagagtaagatctattttatttactagtttgttagcccttgtcccctgtcccacgaatgttagaagcaagcaaaaatgctttcatccaaattaccttcctcttcataaaaataagaaaatcatgtaatcaaaataatcttctgccttctcaatgagtttaccacctgattcagcaattttctaacaccttcatttgcctcattgtaagtagtcccagtgcatgctggttagatggcctctgggtctacatcagtccaactgaatcaggagaggagctccagaaggtgcactggacagtcatgccagaggccgtgtgcaattttaggttagatcagtggttctctgccctatctgaattttaaaataactgcgaaacttctaaaaaatatattgctgctggggttttatctatatagatcaaatcatctctaggggtaggtcctgggctcgagtttttttgtttttgtttttgtgttttttaatctccccagttgcctcctccgtgagcgaaggttgagaagcatagctgcccctgtgaggaactcagccttcagagagagcctgcccgccgcctctcatcctccagagaggctgtagggtgtccagactttgcaggcactgttgttcctcgttaagcctgatgctgccacctaattaacacttgtttatattaattagttgccatatgcattgaaggggagtggtcctttttgaagtttctagttgctgactatataagatttggcctgaagtgggacttctggaaactcaaccaagataacgacttccaggttcttccaaaagcttatcttccaggcataggcaggtaatgaaacaacccaactgcggttttttccataacatctttcaccccacagtatcgatggagcaggagggtgtggacaggctttcctgggtttttggtgctccttgtcaggtgttaaaacaaagaggatcattgtgtttcttggaactggcctaaacgtctatgtttaagattaagatctagggaaatgcatttccgtttgacacccactagtttctgattgtgaaaagggtaccaacctgtgcaatggcgccgcgacccggccgcggactccagcctctaaagtcgggtacctttaattaggagaaattaagtggggctgctacatattttgagaataagtaacactatttaaacttaggcagccttaaccactaacttaaccgctgaattctcgctgctacatgtctcctaaatagatcagcataatcttaactaggacttaaaatgcatcatcttcgttccggaactcagaacctgcagccgacgggagcctttggaggcttaatgactttaattatggcgagaaatatcttctcccggtggggaggggcgcggccggtggcgaggagggcactttcccgggtcggagaaggccggatggcagcccgccccgaaagtcccggcccgctggattgggggttcgggggtggggggaacatagagaagcagggctggtggaggggaggagggaccctgcagggcggtacacgacgggtgggagtggggaggaggagggctcctggcgcggggaggagccgcgggaggggggatgttggccgcagggcctcggagttctgagctgtgtttgtggcttcagcgctttgatctcctgccagggaaacctggaaggtcaggccgggctgcagccaagccctggagcgaggagccggcgggtggagctggcagcactgcgccacccaccctcacctcccaaccccccaagcagtgaagcccgcctggccgccctggcctctcgcccccgctcctgccgctgcccctgcccctgcccctctttacctcctgtgtgttggtctcctgtaggccgtagattaaggggctccaagtcttgaaagtaagctagccaaatgccctgcaagtttggcttagtaaaatcatgtatgttgtatatactttaaaagaaaccagatatttttttaaagctgtgtgcgtccctttcctccaccctcctcatccccaccctagtacaaattacccaagaaccacaggtgattccccctgctggttcgtgagtgttagggtctagtttgcctctcctcttctaccaccaccaccacccccgttcctggcaccaggattttctcaccggttacccgtgtgctcttggtgtgtgacctcatttcctatggaatgaaaagtttctgtcggaaaacagggcccttggtgaggcaggccttgggagcccccttgcccagcgagaatgtcctgtgtcatgcagtgactcatgcttcagagaacagcagctgaccagaatgttcaagagcctggtgcctgggtggtcactactaagtgaagaactcgaggaggaggaaaggaaaaagtgaggagtaaggatttaaaatccacttagtggcctccagagggagggggataacaggactcaaagagcctgggctctctggcctggggtaggacccgccaagagggacctgtgggcgtcaggcgtggccagtccctaggaccggctgggtgctctccatcgtgttaaccgcccttttcccctccctgaccacaggagcaggcctggtggcggcaacagaaacagggctggttcctgccgccctgcatttcagcagtgacgtgttccaggctccggctttagatggctgtgtctctcaagccttcaagcctatgcttaagtctcttgttaccccaaattagggcaccattgagttggggattttgaagctgtggtagaatttgccaccagttcacccagagagccaaggcgccagagcttcgcaccaggtggggaaagcagccaaacctgcactttcctggggttgggccgctgtatggtgtggccatatttctccgcaggttgcaggatgaactccatcagtcttttaggctggaggaaaggcaaggccccctagtgataatgggaggaggctgtaaaaattcacatacagcctgttcttgtggacatggccaagggtagtcatctggccagctttcttttggtaaaggtactaagggaggctcccattcctgcagaatggatggaacaaacactgcaagtggttgggcttgttttcagagagctttgatatccagagatgagcacacgcaggggctggggcctgatacagatccacaacaaggccaagccacttttagtgcctggggtcaaggttggccggaggagacacgatgtctgcattcgaactgacaaccagtaaaaaggctgtcaggaaatgcaacagcagaagatggcaccagtaataagaaaccgaatcctgagaatcttaaagtgcgaagaatattatgttccaagaaaatttggtagagaacagacctttctaaaaagtcaaagggaggagataggtggcctagagtgagctgcaatcagtgctttcagtagcagggcccatggtgtttgatgctaacccctagggcaaaagctgatcttttaggttaatcaacaaacattttttggccatttaccctgtgccaggccttttgccgggttctgggaattcagcaggaaagaagtctgacacactggctgccctttagtgaaggaggcattttaagtaaacaatgacagtgtgatgtcataagtgccacagtggtggagcacagcataaggccactgggcaccgcagcctgagggaataatacctgaacagagagagaagcagtaaatgaaccctgtggcagggggtgggtaatgtgctcctcattgttggtctcctgttaccccacatgtggccaccattgagtttgggattttgaagagaactaaaagaagctcagtctaggccgggtgtggtggctcaggcctgtaatcccagcactttgggaggccaaggagggtggatcacctgaggccaggagttcaagaccagcctggccaacatggcgaaaccctgtctctactaaaagtagaaaaaattagccgggcatgatggtgcacacctgtaatcccaactactcgggaggctaaggcaggataatcgcttgaacccaggaggtggaggctgcagtgagctaagattgtgccactgcactccagcatgggcgacagagtgagactccatctcaaaaaaaaaaaaaaaaaaaaaaggctcaatatagttcaacttaggagtttgagtgttgtgttcagaaacaataagcaggaggaggtcacatcttaccctaagagcagcacagtcattggagaagggtggtgcaggtcagatccatgattgagaacggtccctctgctactgcatggagaccgtgttggggagggggcaggggcgtgcaaggtgggctgggctgaggagcccccagaagagaatgttgttgggacttgtgagaaatctggtgtcctggccagggtggcagcagtggggatgaaaaaacgatggatggatttggaagtcagaatcagcaaaatttggtaagccattgggcataggtgaaaaggcaaagggctgcagttttgactttgccccatgggtggaggaatgggggagatggggtacctccttgaggagggagcccaggtttgggggaagtaaggattgtatgaagagcaggcccatggcaagaccccttgcacctacatccacccgagcaagaaatgacccagaaatgtccgggacagtgtgctgtgctctgcgaatagctgcagaagtaacttggggacccaaaataaagcagaatgctaatgtcaagtcctgagaaccaagccctgggactctggtgccattttggattctccatgagcatggtttctgcccccttcggtcacactacttatatgtaagtctgtcagagaagaggcccaagtgaacactcacttggataagaaggggagagacctcagtgtcttcatgctgctgcttgctaagcaaggtctcttcacccaggacagcagcaagtgtgttatgacagacaattccagaaggtcctggattgtgtcttccttgggatgcctggcacccagttggccctcttcagtagttgtcagatggaactgtatactcgaatgtttccatactgataaccatctcatttaaattatgggtgccatttagtaattggtttccagatcaaaatgtaggtcttctgtcatatccttcagccttccacctgtgagttaaagtgatggggagtgggttaaggggatgatactcctctcaccttgacataccatgagccatggagcagagtcctcaagcgtgctccatggaagggagagtgttaacaggagttgctgcaaacaggctttgtgttcaaaaaagtttgggatgctgggtaaaataggagcctctagcatgttagtgatgtatatgtcagggatagctctggaatgtgcagcatttctcaaaggacaccgaccaggaaaatcattcccttagtagatgcactttgggaaaggctactatagagatatgaggcaagtgaagccatgttcttaatttcttacccatttgcccttggaactaaatgtacatgctcttccttattgactctcctggactcttcagagagggatctgccagcaccatgggcaggatgtgtgcttggtgaggacaggggtctgtgaccacgcttgctgccggctgctgtatgagtccccagggtctagaacacatagtaaccagttaataactaccgtggaacaactaaattaatacatggttaatgcaaatagaatttgactgtgaaccatgcccagggcagtctgctttgttagaccttttttttttttttttttttttaatagacacacggagtcttgctatattggccaggctggtctcaaactcctggcctcaagtgatccgcccacctcagcctcccaaagtgctgggattacaggcatgagccaacgcgctcagccatgttaggctttatggggcataccaatgtggtcggtaaggtctacctcctggctcctgggagtttctgttaatctccaagggtatgcctggcacccaagcgaggcctttatgtataggacatctataccctttgactcagcagaaccactcatggctattaaggacagatgcctccagaatatgagtacaaggatatgaatacagcactgtttataacagagaaaatatagaaatctgctacgtgcctcttagggagatggtcattaaaggagctctgaataaccatacaatggaatgatatgtgtagctggtaagaagaatgaatatttttccacatcaatgcatataaatattgttgagtaaattgttgagttaagggggaagtagagtacagaacagtgtatgtccaatatgtccagtctatttattttaaaattttttttctttttgagacggagtctcgctctgtcgcccaggctggagtgcagtggcgtgatcttggctcactgcaagctccgcctcctgggttcaagcaattctcctgcctcagcctcctgagtagctgggactacaggggcacgctgccacgcccagctaaatttttttttttattttattagaggtgggatttcaccgtgttaccgaggctgctctcgaactcctgaactaaggcaatccaccctccttggcctcccaaagtgctcggattacaggtgtgagccactgcgcccggccttaaacgatttttaacagctggggtctatgttgcccaggctggcctcaagctcctgggctcgagcgatcctccctcctcagcctcccaagtagctgggattataggtactaatccagcatattttaaactacattttggtgggcgtgtgtctgtaacacatgcattttattcttgccaatatgtgggttaaaaaaacaatggaggctataaaccacaccattatgttaaaatgctgggatatagggggtaacagatgagttattttttgctttcaatttctgagttattttaaattgttcatatcatgcacatattacccttataaatagcaaaaactctaaagatgatcgtattttcagggaaaatgtattacagaagtggtaaacaacaagagaaaccctaagatattagagctcagagagaggtatcttatctgtcctttggctaaggagaagcaccattagttttatggaaaaggttacacaggaactggaccttgaaggattagtaatgttagtattaatatgatcaactcattatatttgactctaaagtgtctttctgcatgtgaagtatcatcatctagagagttactctcaaactcacttctttctcccttccacccagctcatcaacagaccgcctaacccagaaattaaatctgttgacaaatttgcctgtattgtctgtgccagtctatctatcttgtcatttatgcagccaagtaagaattgggtgggtatataagaggagcattaaaatttgatgtggattttattgagattcttcataatctttatattctttggcacagggcctacctatgtcctctggaaactagaaatgaaaaccagtatttattcaatgtagtattaattataattttaaaaactggaacaacccaaatatcagaaatacatgtatagtgtgtaggaaaaaaaaatcacagccatttaaaatatttacaaagaatttttaataacttagaagcttatgataaagaaaaaaagccagaaggcaaaattgtattcagtagaggcaaaaaattctgtttggggctcccatatgtctgcaacttcctgtaagaggttgaagacatgtcttcatattagcgctaacagtccagcttccttggttagcttatggtcaggaatgtgggacaaatgagatttttagtcatcttttgggttatttcctattaagactgtattctgtcaaagttttcccgcaataaagggtaggcactagggataccacatccaagagcttgacagaggaacaggtaaacaggtgaaagtggaatccgtgccccagagactccagggaatagagatggcggtaggtccaagccccaaaccaagtctgggtataactacacacactggggagaatgccagatccattcctgagtggaattcctggtaagtggtgggctctaggcttcacgttttcccacccacaaagtggtgatgggacaattctcatcataattggtacatttgcactggaacattctagactcaatcttactagtaaaagcacttccttatgaaagaaaaccacataacattcacagtcagggagcactttctttttaccagtagtaacccgagtatggtaccaggcaagcttgctttcacttataataaacatttattgaataaccataggagtggtaagtgccaaccacaatagggccctgtcttctagaggctggaattttgtactttgcaaatgtattttaagggcgcaagtgtttgctcttttgctacttgtctcaatggccacagacattatctagtctcgagtccagcagccctgggaaggtaaataaaaggaccgtggcaatctttcattcagcactctgcactgggtttctggtcacctgctggctggtgccaacctgccctggcctgagcaaggatggaagtagcaaaggtgatgaaggatgtgaagatacccttgtgggtggggatgaggggaagggcacatagagggcagcaagacaaggcctttggctgcttctgggaggccttgccaaaacttcccacctgtgttctgcagtcacacccttctgttaatcttgcactccaggctgtgcacagtttagggataacggccctctccagctacagcccagtttaccagtgactttcatccaaccatatccaccaggctgcatctttcccatcctttctttgaaagggccccagcttcagagttttggacgttaagtatgtgacttaaagatcctaaagataggatttctggtggccacaagactgtgaactcctaattagggtctaggtttgttttgaaataatattctggtctacacttgagtaattaaaatggtgaatgatctgtgagagtgattggttcaaggaatatgcctcatcaatttttaaactgaaaataagggcagggggcaaagaatgaccaagtaatgttctgttgcttttttttttttttttaagacagggtctcgccctgtcgcccaggctggagtgcagtggcacaatcatggctcactacagcttcaacctcctgggctcaagcagtctacctcagcctcccgaggagctgggactacaggtgaatgccaccatgcctgcctagtttttaacttttttgtggagacagtcttgctatattgcccaggctagtcttgaactcctggcttcaagcagtcctcctgcctcaacctccgaaagtgctgagattacaggcatgagccactgcacctggcctgtatttttttaatttcctttcagaacagtataataaaagtgtctttttctaaatatgggttattcatggcctattttaaatcctaagctggcttctgacaggcaagttccctttaggatcttagcttggctcccctcctgtccagtcctggtgtgtgcaggaaatacaaactgattttaatagtagtttacattaaatattattttaaaagtagatcacctgtgcgaatgaagtatttttctcaaacaaggtatgtccttagatcctgtgcctttgcctggttgtattggaagtcaagctgtaaatggaatttaagcaccatatatatatatatagagagagagagagagacagattcaaacccctgggctcaagtgatactcccgcctcagcctcccaagtagctgggattacaggcccgtgcaactacaaccagctgccttattactgacctgccctcttcactgtaaaaaccaggaaacatatcaccatgtcctagattttgtgaaaaacgtcttttgtgtctctcaaatggatcatgcttcatccggaacctctgagtccttgagacctccacgttccgggcggagcagggaagcctgaactttaagaaggccacgtggctaaatggcttccctgaggcatgtctctcctgggaaggcattccctaccccagatcctgcagcctttcatcctgaggccattagactctccaggtgcacctgcatcaaagcgcacaggtaccgcgctcctgatctggacttatctgaattgtaccttccccgagggtgctgtttgatgtgcttgattgtggaatgaaagccaaataaaggaatgagaggggctgtttatttcctcatttttagtgcttttcctcagggcccttctatgtctggagaaggaatttatgaaaaagcctaggataccacctaagcggaaaacaccagcatctacttacaattatattaactctggcatccatgagctgttggcctctggcagaggagtctgtgtccctaaagagctctatggatagccagtatggtggctcatgcctgtgatctcagcactttgggaggccggaatgggaggatcacttgagcccaggagctcaagaccaacctgggcaacatagtgagacctcgtctctaccaaaaaaaaaaaaaaaaaaaaaaaaattagcctggcatggtagcaggcacctgcagtcccagctactcaggaggctgaggcaggaggatcattcgaggccaggagtttgaggctgcagtgagctatgattgcaccactccagcccaggtgacagagtgaaagcccatctctgatagatagaaagatagatagctctatggtggaggaaagtgatgccactctcgcctcacactttttcagctgtgtcatcagcatcctctcttcctggaggagggtgacagggccagtgtagttctgagttgctctgatagcctgctgcttctcatttgagtgaccaaggctgggaatttagaagggactctagtcataataacataggcggcctccctgcaccccctccccctttttttttttgaggcagagtctcactctgtcgcccaggctggagtgccgtggtgcgatctcggctcattacaacctccgcctcccaggctcaagtgattctcctgcctcagcctcccgagtaactgggagtacaagcacatgccaccacatccagctgattttttgcatttttagtagagataggctttcaccatgttggccagactggtctggaactcctgacctcaggtgatctacccgcctaagcctctcagaatgctgggattacaggcataagccaccatgcccagccatcccccaccgccttttttttttttaacagatggggaaactgaggctgaggctgaaagcaattgagtgacttgtccactgttggcagcatgccagtggcagaggcaggaatagctcccaggattcattcctgactcctagcctagcaatctggtgatgaaacagggtgtggtggacaatcggcagagactttcaatgcattgaatctccattcaaaaagaaagggtcccctgcaagacaaagacagattgtccagagtgccagaacttcttaaactgccaaggaacttgcagtatactgaagattttactgaagttgtttttggtactgtttggtgctaaatacaaggaattggtttgttgtaaaagctatagggtgagactgccctctagtgggccagtggagctattggtctagctgtgttctgggcaactttgctttctcacgccacatcaatgtagagcgattattcctacggaaaggaatttcaattttattctttctcaagcactgtggcccatagtaactctgttgatctctaagcactagccatcatttgcgcgtcttatagaaggctgggtttgccttctatacatacacacattagaagtgtcttacttccctaacaagattcaggctcctaaaagccaggacatgcatgtatgtatgtatgtatatattttgtggagacagggtcttgctctgtcactcaggctagaatgaagtggtgcaatcacaacccaacctctacctcttgggctcaatcaaacctcctacctcagcctcccgagtagctgagactacagttacgtcctgccacacccagctaatttttctgttattttttagataatggggtcttgctatgttacctagactggtctcgaactccagccatgctatatcttaagtcttgtttttccacagcttctgccttgctgtccccttagctggacatggaattagaaggttctttgggatggaaaggaatccttcccccacctcccccaaaaagaatcccgtcacttctcatttgttcctaaaacattctaatctcatccctctgatcagtagttccccaagtagttgaatcatctgaatcccccagaaagcatacacaactcagtttcctgggcctgactccagccctgctcaatcagtctctgtggtttgagccaggaaacctgctttacaaacttcccaagtggcttttgatgtgtagccaggtctggcagccaactgcttcaaaaccccatttacaattatttttcacagctcccaccaccgacagtgtctccagaggtcttcagcttgtgtcacttattaaaattaaccattttgagactcattcagaaatactcaatatattcttctaactgggtgacatgggaaggaaaaaggaaccgcatgagatggaccaaaggcacttgctttggttgccaatggctctgaaacaggaaatactgaaaccaatacctctgtactgactgggcaggttgttgatgtgtaggttgttttcagtatttgggctggataggaagacaaaagtttgttaagttatcaattatgtattttcccctattataagtcatctgacctcatgattaccatacaaggtaggtgaaattgtcctctttaaaaaaaagttttctaattgacagataataattgtacatattcgtggggtacatagcaatatttcaatacatacaaggtatagtgatcagatcagggtaattcgcatatccattatctcaaacatttatcacttctttgtgttgggaatgtccttctcctagctatttgaaactatatgttattgttaactctagtcatcagtccccttctttatagatgggaaaattgaggattaggaaagtgaagtaacatccctgaagtcacctaagttggtaactgtcagattctgcatttgattacaggcctgattgccaaggccaactttgaaaaggtaagaggaccagagggccaacctgctgtttttttaactctggcaggccaagcgagcagtacagcggggagctactgcagtcatctttgatgtgtctgaaaacccagaagctattgatcaggtaagctcctcaggccatgccaacactgcagcctccctgagaaaggcacttcctttagtgagcttggcttgtcccggtcatgtcaccctcatctcagagcatttgctcttgtcttctgaagttaggtgtccatgtttggacataattcccaaaggaggtatactgggcgaggttaagagccagggaattggggcacagggggcattttctctttttttcccccgagatggagtcttgctctgtcacccaggctggagtgcagtggcgcaatttcagctcactgcaatctccacctcccgggttcaagcgattctcctgcctcagcctcccaagtatctggaattataggcacgagccaccacgcctggctaatttttgtgtttttagtagagatggggtttcaccatgttggccaggctggtcttgaactcttgaccttgtgatccatctgcctcggcctcccaaagtgctgggattataggcgtgagccactgcaccgggttcagggggcattttctaagacctttctgggccttctgcttgcccagtccatcccaaaacaagcgtcattctcagccttgctcttctgggagctccaaggctgtaatgttggaagagctggaggattccagacaggtattcagtgttccttccctccagcctttctttctctctactgcttcttaaagtaagcgcaccttttaaccagagccctctcttcttccttagctgaaccagggctctgaagacccgctcaagaggccggtggtgtatgtgaagggtgcagatgccattaagctgatgaacatcgtcaacaagcagaaagtggctcgagcaaggatccagcaccgccctcctcgagtgagcctccgcaccatttggcacaggctcggggccttctctgctactacctgtccctttatttcccttgggctttcattcctatctctgtctgaaatgctggcataccccaggttcctgcaggcttagatcagctattggactcaaggccagggtgaaattttactcatgttcctttatagtgaatttgagaaatcctaccagaaatagatacttttgtgctaagatgtctctggcctcttccacctggcattccctcttggccatctctcatcctttcttttccatcccatctccctctgaaaggcaaactgaggaggattgaagggatggggcatccagcacctggcttcccgtggcttccttcttctatctggcttagacactagaaaaaaaggcttgtatttccttcttcctgtagagtagattaccttattgaaactccccaagttaatttgagtctggaaaagttagctttcaactgggattgagttcgacggctaaatgaatagcatctgcatctcttaagtatgtagaagagacactactggccactaactcttaaccagcctcttctgctcaaacctcaagctgaagaattccaggaaccttgggctggtgccctatattggtgttatttcctcctcacaaatattgggacattcacagtgtaggatgattctttcccatacacaacatagccggttacatgcagcttccactttgcaaagctctattcccattggccaaatggaggtcccagataaggtggctgtgaggttttaggaggcagtgaggaaaaggtaagaactaaaactagagggagtttgctgaactgacttgttggcttctttttaaagggaaaaaaaaaagcgctttggtaaatatgactcattgtagtggaagctgatatttgtggaagcagcatacaattttctgagttgttgtaaaccattaattatacggttagtaatcactgttccctcaaaacatgacactcactcttttgtcctataaatgtgattatttgtgttgatttggaagggcctttcttaccagttacagccaactttgcagtattccacaggctttaccaacagagttcccttggctcttggggggcctggctgagatcgccacaggcgtccccctgggccacaccaaaggcactacatgggcctagggagcacaccatgtgcatgtgagcagaaccccaggagtttcctgcaaattgaggggaaactcatcccggtcaccccatctttatcctgacaaagccaagatagcccatgtgccgcttaccaggctggagagaggctgtgactcactgtgtctgtgttccgttccagcaacccactgaatactttgacatggggattttcctggctttcttcgtcgtggtctccttggtctgcctcatcctccttgtcaaaatcaagctgaagcagcgacgcagtcaggtagtgcctctgtgtgtagcccgtgagcagtaacccctcttgccgtgacactggggaaaaccaggactctcgtcaccttattttttgatggtgcaacatggagcctcacagctgtggactctgagctctgcagcctgttcccagtggcctagaaactgcaaagatggaaaaaaaataagagcaaactaggccaggcaccatgactcacgcttgtaatcccagcactttgggaggccgaggcaggcagatcacttgagctcacgagttcaagaccagcctagtcaacatggcaaaaccccgtctctaccaaaaatacaaaaattagctgggcatggtggcatgtacgtgtagtcccagctactcgggaggctgaggtgggaggatcacttgagcctagagggcagaggttgcaatgagctatgatcacaccactgcattccagcctgggtaacagagtaagaccctgtctcacaaaaaaaaaaaaaaaaaaaagatcaaaacttacagcccagtgccttctctgttctaaaagggctagtcctacaaaggttaagcattgggaatatctccagcaggtgtttcgaaggaagtgtttattttatttttttatttctttgagacaagatctcattctgtcacccaggctggagtgcaatggcatgatctcggctcactgcaacctccacctcccggggtcaactgagtctcatgccttagcctcccaagtagctggaattacaggcacccggctaatttttgtatttttaatagagacggggttttaccatgttggccagcctggtctcaaactcctaacctcatgtgatccgcccgcctcggcctcccaaaatgctgggattacaggcgtgagccaccacgcccgtcccaaaggaagtgtttaagtcaacgttaataagtattataaacactccacaggtctagaatatgtgctgtagcagtctgagttttgagtgctttctctgaagtctattctggcatgattgagaagtgtttgcctgtcccagtacatcaagtggcgccctagagccttggtcctcagatagaatctgtggtccagcagcaacggcagcacctggaagcctgatagaaatgcagggtctcaggctccgctccaggccacctacacagtataccaggctctctgggtgatgcttgattaacagtagctgctgtagcactgcagccacatcactttgtgcttgcaggaaggagaaactcgggtagggggtggtgagaggataagcagagatctggacccccaaatgtatggcagggtcatgtctcaggggagagatggtggatcttggaaggcaatctgtagagaagagaatcaccaaagttctcttgagggttgagcgaccacccccaacaagatgatggcttgtgttttttgagcacagcctatttgccaggtgctaagcacttacacattgtctatttactgtcaccacctccttcaacagaaagaggaggaacgcttggcgtagaacaggttgataactcggggtctggcagagttaggaggcagcaggtccaagtaattggaggagacccctgccttcaaatcagagagacccctgctagtcttgccacttaggaaaagcctaggttgatgtcgtggacaccccacgcgtctggagaatatgtgctatggcagtctgagttctgagcgacttctcagaagtctgttccggcatgatagagaattgtctgcctgtcccagtgaatcgtgtgtcatgtccctggggtgactgccactttcatacgtactggaccctcacacagactacattctgccctgcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggtaatggcagaagcaggcccgtcctgggtggggaaaacataggcaggtcagcagaggtgcccaagacctagaaggacagggccctgtgttccatcacacacatcaacttttagagtcactcttctgaaaattctgagacttgacttgatacttagctgggtgtttttacttacaaagagacaagggattttatatccctcacttttttttcttgtagctctttgaaaattttaggcctagtaccatgcctgtagtcctagctacttgggaggctgaggtggaaggatcacttgaggctaggaacttgaggctgcagtgagctattattacaccgctgcatatcagcctggacaacagagtgagactttgtctgtcttagaaaatttcagaccttcagaaaagactagtaccatagacgatatatgtcaggggcctagaatcatccatgatgaacattttgccacatttgctcactctccctctctctagacagatgcatacatacacatatttgcggggcagggagcaaaccacttgagaattacagacatttgatgcgcctttgttgaaaatgttccactgctgcagagactgttggatggaaatggaatttttgcagaatagaatagtagattcttacacagactctgggttctaatcctgacctgggtggattctagctttgtgatcttgggcaagtgacttcgttttcttgtgacatgggcctgacactgaccagcattccaggtgatcatgaaggttccatgagaagatccagggtagaccctttgtcattctgtcaggcacagtgttaggtgtgagctggaatattactgtactagacaggtcagaaaattgaaagacaaagtaaaatgagcaaatctggaagatgcttaggcttaggaactctggaggtggttctgtcccaataactctatctgtctagataggctgcttttcttataaaccacacaccccatggtgaggttcaggatccagtaaaggaggggatagcagagctttacccctttgctgccacacctgtcaatcatgagtcccaggtatcttcctttctactcatgcctatttgggatacccagggacagccagcacctcagagatgcagaatatcttggggtatacctggccctctctccatacccctaagcctcccatcctcactagcaggaggactcggccctccctgggtggaggcatgagtgtgtttgccctcctccagctacgggaaagacgcctgcctctgtgcgtgcccactcccttaacactgaggactgtggatggggctgactgctggcagtttccttcttcctagaacacatgggtgggccctgcttctagggaattgagccctaattggaggtggggaggagagtagggaagggcacgggcatgctgtgcagaactccttggtctatgctggactctgcaggaggacacacctgcgaggctgaaggcagacttgtgtcccctctctccctgcccaggagctgcgggtcatcccctgtactcaccggtttcacaggaagtgcgtggacccctggctgctgcagcaccacacctgcccccactgtcggcacaacatcataggtaactgtcacccgccttagccattgctgaagagtcaagtgcctagctagagtgtgacacacaccgcaggcttgggaacactcagaaccaccgtggcactgccctctggacttggaggcctggcagccctgggttttggaggttgtctgcacgacccttaggagagcttggcattaagaatcaccctgagttcaagtttgggcttcacattaagcagcttcttgacctcgggcaagacatctggcctctcctaggcctgaggcccctaatctctttagtggcaatgacagtaatggtgtttgcccacacccagtaccatgggggtgttcctaggaccacgagagacgatgagtgtgcagaggccagcttgggctgttgctcctgcatcactgtgtcattaaacagggatggagggacactggcatctttgaatccgattcttttctgcagacttctgtggtgccctgtcaggcagagcagtggggagttgggagcggggcccttacaggagatgggccatttcacacagacaggcaggtcagcctctgccgctgcagctcagtttgggggcagggttgtgagaatgggtaccttggcaggtgaccaagcctgctgcttcagcctttgcccgttttaaaaatccctttagcctctgacaccagtatgctcagccctgcctactctgtttcctccacttgtctccagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcgactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggtgagagcaggaaatggcagtaggtcagagcaggagtttccatcagggtcgtcttgtcttctgtcttaggcattttctgaatgacttcttttgtgtccttggttttaaacaccatctgaggctgaagacttccaagggttactcctcagcctggccctcccttggagttcagacccattgagccctctgcttccatgatctcgggatctctccccaagatgcctgcagcctgtcatgtccacagcagtactcatttccccctctgccctgctccccatccgcatgctcacaccaaaaacctagcaccagctgggggtagtggctcatgcctctaatcttggctcacccaaccactttgggaggccgaggctgtggatcacttgaggccaggagttggagacagcctggccaacatggcaaaaccatggagtcggttcatgactcctcatggctgggatattatgtaggagccacttcataaacattctcgttactcagtacaaaagttagccaggggtggtggcgggtgcctgtagtcccagctactcaggatgctgaggcaggaaaatcacttgaacctggttggcagaggttgcagtgagccaagatcaagctactgcactccagcctgggtgacagagcgagactctgtcttaaaaaaaaaaaaaaaaaaaaaggcaggacccagtggctcatgcctgtaatccctgcactttgggagggcaaggcgtgtgaatcacttgagttcaggagttcgagaccagcttggccaatatggtgaaaccccatctctactaaaatacaaaaaaattagctgggcgtagcgggcacctgtaatcctagctactccggaggctgaggcaggagaatcgcctgaacctgggaggcggaggttgcagtgagccgcgctccagcctgagcgactccatctcaaaaaaaaaaaaaaaaaaacctaggccccatccctgtgcccaccctgccccttgcacttcagcctcctgggcttctcaacccgcctgtgaaggaccccagttgcttgtttttgcctcagtccatgaaaatgaattcccagaaaatgaaacttagcaaaagacatgtaagatacaagtccaggtattttattattagattcaacagacatcagattgctacaagatttccaaacatgctgtctcagtaataaactggagtctagcacctctgagtagcactgcaacaagatctacctgcaaagtacatcccaaatgtatctacttctctgcactcccactgctatcccctcagtccagtctcattttcctctcttcgggacagaggcaataacctctgactgatctgctgtcactggtcttgccttctattccacttggaaccagagtggccttttttgaaacataagttgatgtctttgtgctagaaaacccttcaatgacttgccattacctttaaaatcttaaaaatgttggccgggtgcggtgattcacgcctgtaatcccagcactttgggaggccaaggcaggcagatcaccaggtaaagagaccgaggccatcctggccaacatggcgaaaccccgtctctaataaaaatatgaaaattagccgggcgtggtggcgtgtgcctgtagttctacctactcgggaggctgaggcaggagaatcgcttgaacccgggacgccgttgttgcagtgagctgagatcgccccatcgtactccagcctggcgacagagcgagactccgtctcaaaaaaaaaaaaaaaaagttaactcctggctgagtgctttggaaggccaaggcaggaggatcacttgaggccaggagctggagaccagcctggggaacatagaatgaccctatctcttaaaaaaaaatttaaaaaaaaatttttttttaattagctgggcacggtgacacatgccattagtcccagatacccaggaggctgagcccaagagattgaggctgtagtcatgatctcaccactgcacttcagcctaggcaacacagcaagaccctgtctcaaaaataataataaatgttagcatctcactcagttctgtgtgatccagctcctgccaacccatctgatgagctcctggttcactctccttgcttcctgctttcacctcctgtggcccctgtcccgttcttcccatgtgccaagctcattccagcccccagacctgtccgctacttttctcctccagatcttaggttaggtaacactccagccccctctgagatcacctacacaccttctgttcacttctgtcatcctattgctaaattactttgtctcaaggttcgtaatctctgtgagggagtcctctctgctgcttttcccaaggcctgacgcacaccgggcacccagttaacatctttaatatattgggctttcgtgctacctgagggcttctagaaagctctctacatccaagtgagaggctggctctccaggaggtacctgtgctctcagcacaaatggagcccctctgggaacaggaacctgcttcagccctttagcatacacaggcctgccacatgctggggacagggccacctgagtcccttgcctggtcccatgtgtggtgccagctccctcccctgatgattgttctctctctttcccaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgtt

SEQ ID NO: 3 - DNA, 173896 bp, homo sapien
agatgaaagggccgcggcgcgacggccgggggagccgagctgagcctgcgacccacaaagccgccgccgccgccgccgtgatggggctgtgaggcgtccgcccgcgttcggtcctcagccggcccgcgactatgcccggccgcgcccgccctccgcgccctcccgccgcaggaccatgaggccgcgctcgggcgggcgcccaggggccacgggccgccgccgccgccgcctgcgccgccgcccccgcggcctccggtgcagccgcctgccgccgccgccgccgctgccgctgctgctcgggctgctgctggcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcaggtagctgcccgccgcccgggccccgcgccgcctccgccacaagatggctccgggggctgcgcccgccgaccccgccgcgggctgcctgactggcgggcgggcgggaggggtggccgagaggccggcggcatccctcccctgcgggcgggcaggcgggcgggacgcggcctccggggcgcatccgcggggggcgagcgcacgtgggggctagagctcctgtgaaccccggggcgggaggggcatcctgggcccggcacccatgctggggcagcccccttggccggttgggtatttaggtctgcctcaggtggaagtcccgggaactacctgttgaatgccaactttgaaaagacaagtgatgagggatggggtggctcgtttcaggttgcaggctttgcttttccatccatgcatgttctttttgggtgcggccaggtttgtctgaagggctgcacaacgtcgggttcttccccggaacctgccgtccgcctcacctgggcgccggtgacccttctgcggggctctggacaagcagcagcaggcaggggaggaggcggagctggtcgaggagtggggatcgggggttccctggagtggcgatggaaggcagccctcgctgcatgcttcacattacagagggtgggagggataccgcctgcccgtccctcggccaaagactgatgcgaaggacctgcaaatggggagatggcgtatctcactgacaggacctccaccttggaccaaatgaaagagatctacattccaaaggaaactggctagggagacctttaagccgtgcctactctttggaggagggactctcaactgaagcttctgcggatggttagctgggtggatgtcttcccgcttccttggccgtgattttatcaacttgttactagacagccagcgcactaataatggcagttaatatgcgcgcctcggatgggggcgattcgtaaaggttggcttgtctttgaatctttggggtgatcggatgtctgcagggcctaagctttgtgggccttctgtgctttactcttgggtgagttatgaatgaaaagaaggggactccatggaatgattgcatagcagcccgcagcgtagacagcctgttccgtggtgtccttttccttccttgggtgcagactcaaagccctgccttcataggacagggagagctgtgcagcttgactccgtagaggtgtgcccttacaaagctggaggaggtacccaggcccatgcgattaatcagcagcattgccttaccgggctcttatccccatccgaaaacttctgtagggtaaatagaagaggaaactccttcattgagccctttgactatctatgttaatgcttttggacttaaaaaaagttgtaattatgatctttataagttttagagatgatgctttgctgaagattcctaaacatttaagtcttgctccttggcaacttcttgtctttctttgaggctttcattgtgtcctgatggttttagaaatgtttgatttacagccttctaaaaaaaaaaaaaaaaaaaaaaaagacgctctagcgtggcacttgactttttgaaggagacttttgaagtttgcagtttttatctgcaatgttttaacgtgtcactctttctcaacagtagtttgtctggtgagcgagctatccattatgaggagtgttatgctttggagataatcttgggttcaccatttaatacaaaattagcagtttaaacaccatttgtaactattttatccttgtgagtagagagataatatgtgaatttggcagaaggaatctattctcttctgaaactttttgaagtgcttatctaactcttttgtagtccattagcctagccaaaaaaaaaaaaaagtcaatagttgctaagtaaagtgacttaaatggtatttaataagtttacttgttaagcaatcactaataggtgtccttaattcccttatagctgcagtaatgttggtgagtttatctgagctgtctgaatagtcatttcatggtgcacctcgtatctttagtaactttattgtggtagctgacttgttgaacctccctgtttctgcggacagagtgcagtgtggctttcagggatgtgtgtgtacaaaggctagcatgcttttatgagttctgcaaatactgtttgattgaaggaattggtgtggaccttgtctggcagccctgaaaaagttttttgtaaggaaggctgatgatgttttagggccgctgagagggaatataacattttcttttggtgagaaatgagaaagcagaaggaataaattgctgtccagctttggattaatcatgttttctaagtaacctgaacttttcaaaacctccttttatttactgtctttaaataaacctccttttgtttactatcttgaaaaacctttataagctttagagatgatgctatgctgaagattcccaaacattttatccacagtcttcaagaatagtttgaatcttaactcttgctcattgtaacttcttgtctttctttgaggctttcactgtgccctggtgacacagtctcattgaacttttcaaaacttccttttatttactatcttaaaagaaaatagtagccaggcatggtgactgacgcctgtagtctcagcattttgggaggctgaggcaggaggattgcttgagcctaggagttcgagaccagcctgggcaacacagttagacctggtctctacaaaaaaaaaaagtagcccagtatggtggtgtgcacctgtagtcccagctatttgggaggctgaggtgggaggattgcttgagcctgggaggctgaggttgcagtgagccatgattacaccactgtactccagcctggacaacagagcgagacactctctcaaaaacaaacaaacaaacaaaaactgtgatttgctgcttagtgttttatcgtctcagagcagagttcattttcctataactaaagctaaatagtagcactatagcattgcttttgttatttccactggggttctgtagcagttttatttattcatggtttaggggagaaaaaacctgtttaggagtgtcacctttaagaattctaagataaggaattcgtttgtattactgatttttaacccccctccttattatatgccaacgaagagagagagagagagtgtgtgtgtgtgtgtgtgtgtgtgtgtgtgtgtgtatacatatatttgtatagtagataccttatcatagtctggtttgcctagataattctaactagagtacctgttcagtcatttccatgggttagggtaggggaagcctagttaagaattgtgtcagtttgtcagtgtcagagagagagagagagtgcaagagggagggaggtagtaattcaaaccttaggattcgtcatcaggaatcttggttcttctcctttgcgttttaggcttaaataactatcccaaggtcaccaatgtaatctgaatgaagaattttttttttaatgtctccatctgtgaaagttgtggtgaaaacaatttgtgggtatgaaatgctattagttacttttattatcttatgtatttatgcagtattaaagcctgtttgcttgtaagagtgtcaggcatacagtttgaatgctggagaaattaattacacttctcctgtagttctgaagtgtgggactttaaagggttcttagatatattgatacatatttcatctttgaaccaatttgttgctgttaatgagatcattatctgaaactttcagacttggctgtgcaactcacatggttggtgatgttaaataaaggcccgattaaacaccggctagtggtatgtggattggttaaacaaagaaaatttgcattgctagagatgaaagattgttttaaagtcgaaatgcattttttttttgcttgaagtcaaatatttagaaaagcttgagaaattcatttgtagaaggaatctgaatgacaggttctgtgtaactttaaattcagcctttctgggtcctaggttaaatgctgaatggacttgaaaacagagagaagctgaggacatttaagaactaagtcagttcctttagctattaggggtgggtagagagctgggtggtgggttaaaagggctgatcaaggtccttaaatatccgatgttaagtaaaggtatcacagagagtaattttaggaaactaattcctctgctttgtttccctgtcagtgtgcttctgcagtttagcatttgatcaaacactttcttttcatctccattttaagttaacttaacaggcctgcctctaaaaattgacttggtctaatagaacaattgtgtgctgacagctgacctggatttagacagaaagggattgcctactgtcttctcagatgggccttcataggttaaaaccaagcatttgattcagggggaaaactggggctgtattttgtgatgttatacattcttagagccccttattttctgttttgttccctgagatctcatgggagttactagtacaattctgaataggaatgaaattggagttcagtgtagagctgtagattaaagggaaagtagtgatggtttcctcttatttatacagagcactgccaagcatgtcatgttttggttcttctcatcctgacactaacatgcaattagcaactattgttaatccattttacagaggagaaaaactgaggctgagagaagcaagttgagttctctaacttcacatggctagcagatgacaaacctggattgaaacccaggtctggccgggcgcggtggctcacgcctgtaatcccagcactttgggaggtcgaggcgggtggatcacaaggtcaggagttcgagaccagcctggccaatatggtgaaaccatacaaaaaaaatacaaaaaaaattagccaggtgtggtggcacatgcctgtaatcccagctactcaggaggctgaggcaggagaattgcttgaatccgggaggcggaggttgcagtgagctgagatcacaccactgcactccggcttgggtgacagagcgagaccccgtctcaaaaaaaaaagaaacccaggtctgcctgggttgcttgttcttgtttttgccaagtgaacagaacttggctggttaggattttgacattaattcaagtctaattttgaacaacatataatataggggttcttaacctgagggtcacagactttcagagatagtccatgaactcctgcaagtgtatgcgtattcttgtctatgggcagttacaactttgcctcttccagggttctgtgatgtgtcccctctatacccacaaggaaaaggggaaactctaatctagtagagcattgaataatccattaccaagagtttgagtggggttcaggctgacaagagttgtacggaagtctacaggtctgggtgcctccattgaacatatttattttgtagacatctatcacagccctattctgtaccagacactgtattgctgttgtcttctggagttcagtctcctatggagacagacacatgcatggataaatgataattcttaccaaatgggtttctccaccgaactgagcccttaggccctgaggcatccattgtctataatgaattaacttccctcctgtgcactgcgcagcatccttgggagaagagagaatatagtcactcaaagacttttctgcatttacatggcaaagtgtaagaacttgacactctgaatgcaggatgtgggaaagcagagtatagttccgtttcatagttcattgaaaaatgaaacggagcacctgtcgctgttgaaatgcctgaagagtagcttctcacaccttcccttgtggacctggaccccatggggtctgtttttgctcatttctggatcgaccccctgggttcccactgcctgctatgcatgaggcactcagtattgaatgaataaatgatggagagtggacatcaggcaggcagtgggttttatggattatttatgctttaattgatgagaacaacttgctttggcttggctaataaattctgggattatccttcctttttgattgttatttccagaaacttgcttggatggaaaggatagctctctctctggttcccatagacccactggtattacaatactgggttgtatgaaagtgatctggcccggtgtggtggctcacgcctgtaatcccaacactttgggaagccgaggcgggcagatcacaaggtcaggagatcgagacaatcctggctgacacggtgaaaccctgtctctaccaaaaatataaaaaattagccgggcgtggtggcgggggcctgtagtcccagctactggggagactgaggcaggagaatggcgtgaacccaggaggtggaggttacagtaagccgagatcacgccactgcactccagcctgagcgacagagcaagactccgtctcaaaataaaaaaaataaaaagaaatctgtgtggggtgtttatattccaaggcagggtacctggcataagaaaagtctgaaggtgttcttttcctgatgaaactgagtattgacaaagccttaaagtggataggttatggaaggaaagaatcttgaatttccagtgtccctgggagtaacaataagggattggcattcagtatcatcgttaacctaaatatatgccatgtgaaaaactttgctgcttgcttgctttctctctctctctctttttttttttgtcagggtctcaccatgttgcccaggctagagcacagtggtaagatcatggctcagtgtactcttggactcctgggctcaggcagttctcaggcctcagcttccccagttgctagaattacaggtgtatgccaccataccgagctaattttttattttttgtaggtatagggtctcgttatgttgcctaggccggtcttgcactcctggcctcaagtgatcctcctgccttggcctcccagtgctctgggattacaggtgagagccaccatatctggtcagaactttgcttcttgatggtattttcccaagtctggagagtttggatttctaatttgtgacatttaagtaaatcttcataatcaaaagaaccagattcagtcctttaatgtgttagaaaggagactgaaatccagagaaatgctttgctgaagtccacataaggtagagatgacccaggattaatatttgggtcccctgactcccaggcttggagcccttctgttacccccggctgtagcctggctgagtgtgacaggggacaccagatgcagggcatgctttatgatcagatgtataattgaggaaagccaggcattcttaaattgtatattgggtttaagtggttgcttttcttctctaattaatttagattttgagtctctcagtcttcctccctgtcagagcttttaaaaatagctactaatgatcaagtgcttattgtgtgccaggcactgggcacagtgctttgctcacatttaacagacaaggtagatggcatgtgccagagaggtaaagtcacttgtcaaagtcactgagcaagtcattagtgcagctgaggttcaaatcctggtctgtctgattctaagccatttctgttttcacaagcccgcttcacttcacactttcttatgatgaggttatgggaactgatgtggaatttagagttgagtttaaacccaaaacgattgaccaagaaataagtctataacgtcaactgagaaaatcccctatcctcacaaagatgtatttccttcctttcttttcctcttctttttttaaatcacaaaagtctcattctaacttagttttttccataaagagccaatctaccaggttcacaaagagggaccagtgacttgacatatataactgtcactcgatggcacttctgttgttttcagctattgggcaagctggaatggctgtagttttctggcatttaaagggatttctggtgtgagacacacctccttcctgtggctgacttttatagcaatttgggagtctgcatgtctttctccaaagaggtcacgtcccatgtttgtgacctttcttactttgcacaggctcattgaatcctcttggttgttaaaacttaccacgagtgctacatgcctcagtgggcaaacattcagtggtgccccccgtccatcagatcctttgtggggcaaggcaatgaacacaagagtaagacttggtccctgcctgcaggcagctgagtgtaggtgtccagacagcacacgaacggttaccttacagtacagtggggcatgtcctatctggtaggaaacagcctataggatactgaagaacacctgggggagggaatcgggccctggtgctaagtttagacctgtctgtcactgtatgagcattctggccttttccaactcatttttacctacctttgaggttaaagctgataacctctttgaagagaggtgcctttatacctttctaacggaataggaaggaggtagagagtagaggttctttgttctatttgtagcttgaatgagatgttttaaaatctgactttcagtggctctgtttactcatgatagtgtcaaaagaataaggtcagctggcccattgtggttcaaaggagagcactttatttttattgcccttaagatgtgttgtaagacttgatattaatttcctcctctccccagcagccagtgtaatatagttgtttagaaactcagtatagagtttgattctgtgaaaacgaagtttgatcctagaattttgatgggaaaacgtatgttagaatggggacttctggcctcctggtgcagaagtgcctgcatttaaaaaataaaagagccggcgcggtggctcatgcctgtaatcccagcactttgggaggctgaggcgggcagatcacgaggtcaggagatcgagaccaccctgactaacacagtgaaaccccgtctctactaaagatacaaaaaattagccaggcgtggtggcgggcgcctgtagtcccagctactcgggaggctgaggcaggagaatggtgtgaacccggcaggtggagcttgcagtgagccgagatcacaccactgcactccagcctgagcgactgagcgagactctgtctcaaaaaaaataaaaaaataaaaaataaaattaagagtggggtagtactcaattaggtgtgtgtaagttcccatccagcactgtaagaattttattataacttaattttctacttgagttaatttggctttgctatcttgtcagcaaacatttattgaatgtttactgtagataccgtatagagaagaaacatcggttttatgcacccgtggtataatttgtgcttttcaaatgttatttttctgatttattcgagagtttgaggctgcagtgagccttgcagctaccagtgtgagccaccgtgccagcattggtaattttctttctttctttttcttttttttttttttcgagacaagttctggctctatcgcccaggctggagtgcagtggcgtgatcttggctccctgcaacctctgcctcctgggctcaagccatcctcccacctcagtctcccgagtagctgggactacaggtgcacatcaccacatccagctaatgtttgtattttctgtagagatggggtttccccatgttgctcaggctggtcttgaacttgggagctcaagcaattcacccgccttggcctcccaaagtgctgggattataggcgtgagccactgtgcccggcctgccttggttattttcataagatttctagaattaggttcactgagttaagtgatataaacatttttgaggcttttgctacatatttttagattgctctacaggagtggtctagtttatacacccctaccaggtcgccatgtatgtttctacacaatagccctgctcgcaacagatagtatattttgctctgttgcccaggctggagtgcagtggcgcaatctttcttggctcactgcagcttgaaatctcaggctcacaagtgatccttccgcctcagcctcccaagtaactgggactacaggcatgcaccaccatgcctggctaatttttttttttttttgtagagatgggtttttgccatattgccaaggttggtctcaaactccagggctcaagtgatccacccaccttggtctcccaaagtgctgagactataggcgtgagccactgtgacccactgtatgtttctcaaaaatacaaaatgtcgtaaaagtgaaagtctatatattcctatcatttagtaaatagtaaaatactggctttttttttttttttgtctgccataaggatctgaattatgactaatgtctgcactgaagggaaggtacctggcgtggcatctgggtgcctcccttgtaggtgtatcagagcatgattcaggagcagcaggttgcccttgtattctgggcaggaacacggcgtctgtccaggcagatggccatgctcagaggcctcacggtggggaccgctgtgctgtcgtcacaccctgtggcagcagattgttgcccaggagggtgctgcttcagttgctggtttctgcccttcctctttcctgtcgagcaggctttctgcttctgaacaggctggattcagaaaggccgaatgaatctgtccttgaattcatagtgacactgtcagttggtggtgggcagagatgcaagttgagcccaagcaccagactctcaggggtgcatttaagcagcaagcatataggctgaaaacagcttccaggtattttgttcgatcgctgttaaaaatctagaaagtgtacataaaaatgggctcttctaaaaaaaaaattaaaagatctggcatcagtgggtccacagtcccatgaggcaatagcctgccatagtggagtggcagctgccccccttcagcaggtacacaggccctccagtcacaagtccttatcgcattgcccagcttacttccctcactgacagttccatttacagatgcctggccctgtagacactgtagctggccatcctttctgtctctggaagttccaaagttgaaagcttttaacttgtgcttggcaagtctcttttctctccttccccaaccaacctgagtgtgagatgtccatcagtggaccccatgagtctcaagttatgctactgaggaaggcccagctacccttgatgtgaccagagggctctttttgctttggtgtaggtgttgaaggctgaagtctggagccattggcctgtgccttcaggatctttgctccttctctctttttggctccatggtttctcaactctgagacttaattgtttgtgctgaagggcaccttgaaaatgctgtgactccggccgggcacggtggctcacgcctgtaatcccagcactttgggaggctgaggcgggtggatcacgaggtcaggagatcgagaccacgatgaaaccccgtctctactaaaaatacaaaaaattagccaggcgcagtggcgggtgcctgtagtcccagctactcgggaggctgaggcaggagaatggcatgaacctgggtggcggagcttacagtgagccgagattgcgccactgcactccagcctgggcgacagagcgagactccgtctcaaaaaaaaagaaaatgctgtgacttagctctccttttgcagtgagggaactgtgggcaagggcatctagcctttggtcttaagagctgggattagaactcagaacttggggttctcgggggaggggtggtctttctagaatggcattctgctgcgatggttgaattccagaaaatcttccatgtgcctgttgctttagggttcctggtgtactttcacttacagtatcttagttcatcctctcatttgggagtgccttttctggattctgccccagaaggctgtctgctgttcaggtggtctgaggcggagtcttgctctgtcggccaggctggagtgcagtggagtgatcttggctcactgcaacctccccatcctgggttcaagcgattctcctgcttcagcctcccgagtaggtgggattacaggcgtccaccatcacgcccggctaatttttatttttatttatttttatttttatctttttgagacggagtctcgctctgtcggccaggctggagtgcagtggcgcgatcttggctcactgcaacctccgcctcccgggttcaagcgattctcctgcctcagcctcccgagtagctgggactacaggcgtgtgccaccacgcctggctaatttttgtatttttagtagagacagggtttcaccatgttggccaggatggtctcgatctcttgacctcgtgatccgcccgcctcggcctcccaaagtgctgggcttacaggtgtgagccaccacgcctggcccctatatttttagtagagacagggtttcgccatgttggccaggctggtctcaaactcctgacctcaagtgatctgtctgcctcagcctcccaaagtgttgggattacaggcgtgagccactgtgcccggcctgagaatgcttttctttgtacctaatttgtatacttttctttaaatgcatttgacattgtgtgtttagcacctttatgggatttctggaatatcgctgggtacctggagacttggcatcttttcagaaagtacatcagtcttggagtaggtggtgagcagacagctaatggcatgtaaagaatgttgcaagcttgacttgcaaagctatttcaaaatttaaataaaggtagcttgtggctgagttgaagggaaatggtggtatcttcaagacaatgcttggcttgctctgcctcttgctgacttccctcttcaggcctgatgctgcccaagctgtttccctgtctctcattctctctcttttggtttttctttttctttgtttttaaaagagaccaagtctcactatgttgcctagactggacttgaactcttgggctcaagcgatccttccgtctcagccttccgagtagctgggactatgcaggcatgtgccactgcagtcggctctcacattctctttcttcccatcagttcttcccttcccttcagattcatccttctaaagtagtgtttggtcacatcagtctcttgatcaaaatctttcgtggcgtcctgttgcttactactgagctgtgtgaagaggtgacctagctgccccagtctctcattgttgcctccgggcgtgggcctgtgtgttgctgtccttgttcctgagtgggtcctgggctttcctctctcagtgcttttctttcttttttagggggatcggggagacagaatctcactctgtcacccacccaggctggagtacagtgacgtgatctccgttcactgcaaactctgcctcacgggcttaagcagccctcctgccttagcctcttgagtagctgggaccacagaaatgcgccaccacgccctgctaatttttgtatttttagtagagacatggtttcaccatgttgcccaggctagtcttgaactcctgagctcaagcaatccacctgcctcaactcccaaagtgctgggattactggcgtgagccaccgcacctggcctgtgcctttccttttggattgcctgctgtaatacgtgtcttcacctccacattttcaactcccgtctttgctttccactgtctttttcctgtcctagctcctcccatctgcagccaaactttcagtccttcccatgaagctttttcctgggttccaccagtgtgttcctttgaatcagagcactccatctccctattgtcttggatgtaaaacatgtaaattatttaccgaaccggaattctcctagatcacactactttgggatagcatagtgagagggatgtgaaaggggtgttaatgtggcctgcagaaaaaaaggcttggctttttttctctttttttaggtggggtctcactctgtcacccaggttggagtgcagtggcacgatctcatctcactgcaacctccgcctcctagtctcaaacgatcctcccacctgagcctcctgagtagctggctgggaccacaggcacacaccaccacgcctggctaattttttgtatttttcgtagagagggggttttgctgtgttacccaggctgctcttggactcctaagctcgggtgatctatgcacctcggcctcccaaagtgctgggattacaggcgtgagccactgtgcccagccaagacttgtttttttgagggagaattttctgtgattgtcgcaactatttgcaagcagctttcagacatggtgtgtcctgattattccaaatagttgggatagtccagactctcaaaataatttcaccttgcctgtgcttcctggaggtctggagaaaggagacagtaggaggtgacaccctctggctccttccagtctggcgtgtgcctgccctgggaacattgttcagaacatgctggagaagagaatatcacagcctgactgtagacttttggggatgtgttttatttaaatatgtaaaatataatattttggtgtcacttaaaacaccgggacttttggaggcgtagtagaagttctatgtagcttcagaatgacccatcagaaacaaatgtatatgagtctttacttacatttgtgccatattgcttccccctatatttttttccctttggaagctctggcatgggccttgatcctgtgtttaagcgctgtgtgggaagcagaatttaaaaggactgtagtagtatttctaaagagacttaacaggctacatgtgagagaattttagatttcaatttagcaaacgtttgattttctagtctttatggggctgactgtaagcatttgggaaattattgaattattgcttagttctgtataagttgacatgctgaggttttttttttttttttttttttttaactgtttttgtgggacagtggtgattacatgggcattgggactttcaggaatattccagaatctatgatatgttgtatttcacttgtgctagagggttttcaggctgccttttcatggcatgttcactccagaaatgctctaatgcccatcaataaatgtcaccctcatcctaggaattagatgaagagattatagttttgaagttttggtgttattaggcttaaatctctaggacacatataaacacacttgtggtattaaatgtgccgggtgggtgatttcaagttccagtggcagtggtaatttttgcatttcctgactcttgtgtttaaatttgcagtctcaacattgcatcactgtaagttttcacatttaatgaatatttatgttgagccaagttctatacgaatgtggtggtttctgacttgattatagcttgctgtgtactgtggccaggagtgccctacagacaacagagttggcacacgtctcagcatgccaagccccggcggatgtggttagggaccacggtgactggggcattggttgccataccaaccttgtttttggaagggaaagctctgaaacagcaatgggatgggggcagaatagttttgaatattccaagtaaacttattccctatatgttccctgcaagaagatgctatagaaaactataattcttactatgtgctcagatagcatgagttaattttctttcttttcttctttctttctttcttttttttttttttttaagacagtctcattctgtcacccaggctaaagtgcagtggtatgatcttggctcactttagcctcgacctcctaggctcaaacgatcctcccacctcagcctcccaagtagctgggaccacaggcgtgcaccaccatgcccagctaattttgtttatgttttctagagatgaagtctcagtgtgttgcccaggctagtctcgaactcttgggctcaagcaatagttagtttacttttgcaaggctgttttaattgtccttttgcaaaggtgtggaagttatatggtgggcctttcatgtgtgaatttcttccctacttgttggagggtaaacaggggatcttctatctcttcctattacagaccttcttctctcaactcctgccaacctcccttgccctctggtaactaacctagtgatgactgattgggggagggagaagggaaagaaaaacaggaaggataaatgggggactcctcctcccccagctccttatttatattcctcactttcccttataccaagatggggtttccttgctcctccctattgtatataagcaaagatcacagtcgaaggtgccatcacccataagtgggatgttagggtgccctgctcacgagcttcggcagacagaactgggatgagaggaaggaaacatccctggcatctcacactggaatgctgttacctctttgcaaatggtgccttgcatgattaattctatggtacttggtattgtgcagtaaaatgtctggaagggaattgatcaagtctggtaagccagatcagagcccagaatggcagagtgggatgtgacttgcaggtggcatctgctgttctagtgcctctttacagaagatgatccaagtctctggaagctgccacctgtccaggttcaacagctcaggcagtctgttgttgtggagggcttgtcctcaagcctcatcacacaaaaaaagtaaaaaccccacccctttgaaaagaaacttactgtttcagaagagggaggcagtccaatgatttaatctttgcttgctgacttggagccaactccccattagattgtaacctccttccgggcagggttggtgtttcaatctatttaacatttttcagctgggtgcggtggcttacacctataataccagctttaggaggctgaggtgggatgatcgcttgaggccaggagtttaagaccagcttgggcgacatagcgagactgttcctacaacaaattttttttaaaaaaattagccaggtatggtggtgcacatctgtagtcttagccacttgggaggctgaggtgataggatcacttgagccctggaggttgaggctgcagtgagctgtggtagtgccactgcattccagcctgggtgacacagcgagacctgtctctacaaaaataaataaataaataaataatttttttttaaatgcagaaaacatttcccagttcaactcaaagagcctctttgtttgaatttggaagagctgtcccttcctgaagatacctgaattctattttctgctcatcggtcataatgtgaatctaggatgagcacagatgtgaacggcacctcctagagttgtgcggtgcataaggccaacgcccagaaggcactcttccatctccctgttggctgacgtggcacctgagttgttcccccttctctaatgcttctccttcagcaattgtgatttgctgcttctgatttctgtagtcctaggaaaccagggaaccatgtttgttagaattatgtgtaaagttaggggacagagacatcaagggggtgtgtaagtagtttagtatgtggctgctttggctgcttttctgctttttgctggctcctctttagagatcagctgactggcgcatggagtcctcaaattttgggggcatgtaataaatgatggatggacctttttttttttttttttttttgagacagagtcttgctctctcactcagactagagtgtgtagtggcacgatctcggctcactgcaacctctgcctcctgggttcaagcgattctcctgcttcagtctcctgagtagccacgattacacgtgcgcaataccacgcctggctaattttttgtatttttagtagagatggggttttgccatgttgcccaggctagtggctaggcgttttatggtgcagaaatggcaccactattttgtgagtattcctaatcaccaacttttaagttaactttttttttttttttttttttggagatggagtctccgtctgttacccaggctggagtgcagtggcatgatcttggctcactgcaacctccgcctccagggctcaagcaattctcctgcctcagcctcctgagtagctgggattacaggtgtgcaccaccatgcccagtgaatgtgtgtatttttagtagagatggggttttaccatgttggccaggctggtcttgaactcctgacctcaggtgatccacctgccttggcctcccaaagtgctgggattacaggtgtgagccaccgcgcttggcaagttaactttcattcacctggtttgggtataagttctctttagttcttcaaactacaacttttagctgactgtatttaagaggagttgggaggacagagcagtagttttccactttgctacgcagacacccagcatttgccaggccttttttttttctttttttgagatgggatctcactctgttgcccaggcaggagtgcagtggtgtgatcttggttcgctacgaactccctgtcctgcgctcaaatgatcctcccaccttagcctcctgagtagctgggactacaggcgccctgctgatttttgtatttttcaccaggttctttaagcatgttgtaaactttgcagaacaaattggttctgggtttcctttgatgggagaggctgcagagtgctgagtctggagccagacagcttgggtttgaatcctggctttggcagttacctgctgtggaaagatggctttgcctctctggatctcagtttctgcatctgtaaaatggagataaacttttcctagcgttgttatgaggattacatgagttactcacagcatgcaatttatatttagtggggatgaggttgaagaaaatacataatttcatgctgctcctcacatatacctaacgtttatgttgcagttcccaagtggttgcaaattcttattctaaaatggtagcttatcaaagttaaaggaatccaaaaatgccatttactgagaagagaagtggtcataacataggaatttttttttttaacatgcttagtgcctttctacttgcacctatgtcccttctcccctagtgtgggggtctgtgggctccccagggtagtgcttaagcactttgcaagaggtgcaggctgctcatttctccgattcccagttccctctgtttcctgggagggacgctttgctgcagcttcacctgcttatccctactctctacagctagatcattgtccaggccttaagctctgtcagtcgggcacgtgtgcacacacagacacacacacgcacagctggatgtgaactcttgactccagtgtgtttctaggccagcctgcttgttgttcctggttgctccgaggaaaggagggtgctgattgctcctctggatccagccggacgcatggaatgctgcaacatactaagcctgtgctctgggggcctaattacgtgggacttggggcaagcacaagtgacttcagcgcttggtttgatccagcgtgtgatttttgccaaagcaaatactttattaatcttaaccccccaaattagacacattgactttttctaaaaatgggaatgattggagagcagaatttttttttaaatcccctccccatcctgaacccctcctccagcaagactgggctctgcattcctctccttgaatggagaaggtgagttccatcactgcctacctcctcctctaacattcctgaaactaggtgctaggaaattgcccctttctgaaggtgtgttttttgtgtgttttccgcaagaggttccactccttcctacgtcaaggccaaagaaaggatttgccgtcctgatggaactttcctaactgggaacttgtcctggatttcttgggattctgatccagaatgtgtatagggaaaactgttgggtgacttcccatggtgaccttgagtgtgtctgagaggctcagccagaatttcttgtgtggcctgtgagtgagctagcaagccagcgaggtcagtgggccttcccgctcaacaccctgtctctctcctcaaagtgtcttgggtaaagggcatactcacagggtggaattaatctggcgttagagagtgagcttgttcttatctagtctaaactggaaaaaaaaaatgcatttaaataagcaacctaacctcaccccagaaaacaactcctagttaaccttggctcctcttcactcggcctctgtctttaagtctgagtgacctggtgggattgatcagctttgaagtcctaaggtgctattttaatactgttcttttacgttgcaggcttcgagactgatttaactagattctggagggagcttactttacagcattcttaagagctcgaacaatcttgaaagagttaaactctaattagctcattcctaaggtatttaatgcccttattaaaactcaactgctcgttcacttttttctttagtgaatcagatttcttgaggagctgagccttcgctcctcagatcacaggctcacatgttgaagctggcagtgctagaggctagttcctatctgtgtgacagcatttttaatttaacaggaccgcctttgatgttcccaaatatttataggcagctttagatcatttcagtgtgtgctttctttttcttctctctctctctctctcttttaactggagcaaaagttcttcctcatgcaacagccttccttttatcctgtttagtttatttttgtttcctttgcagctttggcgaaggctgtctggctgcattcacacacacacatgagattgacccttctttttgcttctttggtaaaggctacctctctgtatcctcctgcctgcttgagattgcttaaggcacttctgttcatcccttgactttcttcaggctgagttttttcctaatctggctcaggaatctgttctttggctgacctgagagctttcagactatcatgcagacctgggcattgtgtgaaagtgtctttttttttttttttctgagacagggtctcactctgtcacccagactggaagtgctgtggaatgatcatagctcactgtcaccttgatctcctcaagtgatccttctgcctcaacctcccgagtagctggtactacaggcacctgataccactcccagctaattttttcacttttttatagagatgaggtcttgctttgttgcccaggttgatctcgaattcctgggctcgagcaatcctcctgcctcggcctcccaaagtgctgagattataggtatgagccacctcacctggccttgaatgtgtctctttatggatgaccaggctgtaatatcctactctgcttgcctgcattgacactgatggggcctcagcaagttatgatttacagtgtatgttttgcagatactgttttagctggggcaggaaattcagatagacagaattctgtcctgatcatttcaggcttgctctgtttggctctgttagacttcttggctgaaaataacagagaatcaaagattttggtctcagggatgggaaaaacagggctgcaacatagatttgttaagccattaagaaaaagaaaaaggaaactttgtaccaatcaaaacaaatgatagaacagaggatagtgcttcctccagcttggcctctgggtaaacattctgcttgtgaaacaatccaaattactgaattctcagctgctgttacttacctgggcctggcagacagaagaccagaagatatcatggcttcttccatcattgctggctgtgcctcctattaggtggaagccttttagtgctgaaggtctcataggtggttgatgaaatgtgtgaatgaatgaatacactattcttgggaccttatactgtttttctcactagatccttaagaggattctgagcgataagatatttcatatctgtttttttagatgaggacactaaagtgcagagaggtttatacagctggtgagtgaatggagaagctggcctggagctcaggactgtgtcttatagcctcaccatgaggtaattggaggcaggtaaatccaatggcagtctgctaacctcttagagctaaaaaagcctgttgaggctaagcatggtggctcacgcctataatcccagcactttaggaggctgaggcaagtgaattgcttgagcctaggagtttgagaccagcctgggcaacgtggtgaaacctcatctttacaaaaagaatttaaaaattaactgagtgtagtggtgcacgtctgtagtcccaactactcaggagattgaggcaggtggattgcttgagcctgggaggcagaggctgcagtgagctgagatggcaccattgcactccagcctaggtgacagtgatctgtctccaaaacaaaacagaaacctctcaaggctaaaatctactgtatgttgcattgtgagagttcagagctgaccagattcttgccatgtaaggggcatagtggtggagagtacatccctgagaccagataggcctgtgttttgcatctcagccctgctactgacagctctgtgaccttggccaggtcatccaacctctctgaacctctgcttcttcatctataacatgggacagatagcttgtacgaccaaaagactatgaaaattagatgatatatgtaaggtgtacattaagtgcttaacacatgttcggttggtgtctgttgctacaaaattgtgactctcaaagggttcatagtcctgcaagaaagcatcaggtaaaccacctattagaagacgacttggcagctacaatagagagacgtgctggtgctgagtaggaacccagggcagaaaccactggcttggatttttattttctttcattcagcagatatgtattgagtgcttaccctgcgctggcagagccactggatcacactgattgctgccagctccccctcacctcccaattttctctttcccttcttgggagaatttgagctaaaatgttaattgccacctgaagaaagattttcacggagtcattttcttttctttctttctttctttttttttttttttgagatggactctcgctctgtcgcccaggctggagtgcaggggcaccatctcagctcactgcaacctccgcctcccgggttcaagcaattctcctgcctcagcctcccgagtagctgggactacaggcacacgccgccacgcccgtccagttttttttttttttttgtattttagtaaagacagggtttcaccatgttgcccaggctggtctcgaactcctgagctcaggcaatctgcccaccttggcctcccaaagtgctaggattacaggcatgagccaccgtgcctggccacatggagtcattttcacataaaatgccaaggtgccaaatggcacagccacactgcatttgaccatgtatcttacatggccttgtgctgtccttcaactctcattttaatcttatctaattttctccaatttctctggtctcttctacatgaaaactttatggtccttgagaatgtacaagcgactcaccaagggagcaggtggtggccgcatggttccccacagtgcccagatggtgtccgtgcctttcatggtctggttccatggggatttgttgataagattttgctttcatttggttttccaacccagcagcatatttagatttgattactggtactagcttttttctctgcagagtttcattgtctgagtcactggctgtcttgaaacataagtcccattctccacacccctgtacccctttgcaatcagtggggatggttatgtggtagaactttttccctgcccacagcgcatggtgcagagtggtgtcagcacactttcacttgctgagttgattggtaacatattgaatctagaacaaaagatacaattgaaaagcatttgtggttgtctttgtatagttacaagcctctaaaatagatttgaggtcatttctatgtctttccttttgaattagcaagcaagctttcagagggaagtgggcgttttctaaatgcactattgatttgaagctaacatgatgctctacttttggatcatgaaaataatgttaattttttatttggctgtttggagggaccactggagtaggtcatttatattcaactcttattcatgctttctttaaatagcatgtttaatttcacattaaaactagcttctgttcagctaaaacaaaaactgaaaagatggtttggaagaaagcaaaatgacagagaaaatgcagcatgcaatggaaattggctgcaagtcatctccataaggtgattgagaatgaagtgaagctcagctttctttccaaagaaccctcaacaaccctctatgttaacttaccttctcctgggagtcttggtggcctccttttgtccttggtgtatgttgcatgccaatcatgctgtagagaaggcagtaatatctagaaacacatcttgaactagcgttgggccgtgtgcaagtctcttttggtggggatatgcgagagtcactaactagcaacctttagggaaaaagaagtccaagagggttgaattagtaaccactggggcctgtacgtggtgatgtttgcttttttaaatgatccttgtggagcatcatttgccctgtgtcctatggggcatgtcaccccattccctggatgtcaaaactaagaacagaagcaaaatccattctgcattggctctccttctttagacttagccggattgctggatgcgcggtcagttggatgcaaatttgcttttgctaaagaaaaagaaggcctgcattaataatacaatgataagacctgtgctttcagtttgtgttttttaaagcggtgattagatttgtctgggtggagagcaaagatgaagctattggtctagtagagaccattggtccccagatgagggcctggtgtctccgttgggtgttttgtttgtttgtttgtttgtttttgagatggggtcttgctctgttgccaggctggcgtgtagtggcacgatctcgactcactgcaacctctgcctcctgagttaagcaattcttctgcctcagcctcctgagtagctgggattacacgtgcacgctgccacacccagctaattttttttgtgtgtgtgtattttagtagagacagggtttcagcatgttgcccaggctggtctcgaactcctgagtctgcctgcctcagcctcccaaagtgctaggattacaggcgtgagccaccgcgcccagcctctgttgggttttttaggcacacttgtctgaagaaagtcttttgattttgagccactttttagagctttgaagctcttcctgattttaactattgctacctatggaagagttgctctttgggaatggacagcaacttggggctaacagcttttaagcatggacctctcctgggggcgtgttgggcctgtttactaaccttactgtggactccgccttcagatcaggatgattttcatggtatttttttttttctcagaaaataatcaaaccaaaactttcccttgctgatacagagtgactatgcaaatcaggtctgcatgcttatcttcctagaaatgtagttcagtgaaaagaaaacagcgccttcctttagcccacatactttcctcattcataaaatgaatcagatgaaacttgatttcacccaggctggagtgcgggggcgtgatctcagctcactgaagcctccaccacccaggctcaagggatcctcctgcctcagcctcctgagtagctgggactataggcgcatgccaccatgcctggctaattttttttttttttttttttttggtggtagggaaagggttctaccatgttgctcaggctagttgcaaactcctgggctcaagggatccattcacctcggccttccaaagtgctggaattacaggtgtgagccaccatggctggtcacgcccagctaatttaattttttttttctagagacaggggtcttactatgtttcccaggctggtcttgaacttctggcctcaaatgatcttcctgccactgcacctggcctgatttgtatttgggagcctcactttctccattaactttttttttttttggagacagagttttgctcttgttgcccaggctgagatgcagtggtgcaatctcagctcactgcaacctctgcctcctgggttcaagcgattctcctgcctcagcctcctgagtagttgtgattacaggtgcccaccaccacaaccggctaattttttgtgtgtgtttttagtagagacggggtttcaccatgttgaccagattggtctcgaactcctgacctcaagtgatctgcccacctgggcctctcaaagtgctgggattacaggcatgagccaccatgcccagcctctccatcagactttggatctggaagatagtaagaaaaaaagcaaagtaacttagttctgtcctttcctagaggacgtaagcagtcttggcctcttcatgatggtccactttgttaccgaattattgggtacaaaagtgaggtctgcaacaggctttggatgtttcaaggtgtgtctggctgtggtttgctttctgagtgccagctttaatgtcctcttattttctggcaagggttgatggatgtggcactgaatattttctgaatagtgttcacagaatcaccgagtgaatgctggcctcctcctgcatgtctgttgagggagggcttatggaccagtgggaaagtcagatgtgtccctgagatggtgacagtataacatgcataggctgagtgccaaatgcttggggcccagagaaagtgcctagaaatcagagaaaggtcttgggggtggacctccagctggactcttaaggaagattggtgcttggatttgctcctgctggctcttgctatggggaaggcatttcttgctgagacccaggctaggctggcaactagtggagctttttctagcttgtgtagacctggaggctgcctggcatagaatgtgcccatggcagggcggggagaaagaagaggccaagtgaggtgcggctgggagacaacagatctgctatgctctctggtctgtcatttaagtgggatctattggattcagcctttctgagcctcagtctccacatctgcaaactgggtgtggggctagatgagattcctggggggaattgggggatctgcagctgtgcctctgaaggatgtctggggacagaagtgtaagtggggaagaagcacactaactggggaattggggagggaaagaactttggagggcaagttaggggagggataagaggggctttgaatgccagaaaagggtatgtgacttttatcatggagaccagtgggtcccatagtcagaatataggtgatgtctatgtgcatgaccgtgtttttggtgacacaactcccgcctgccctgtgtcctccagcagcatggtatgtaattgcagccctcactgcacagcagtcggcaggcttattcaggggcagttttccagcagtcactcctctcttgagaacagtctggaatgtaagggagtaagtgatgttctagtgacaaccttgaattcactttattaaagataaataaatcacatgccaactctggcctttagctgttattagtaacaaatagctttctacccgtacacttgaccattcatgacaccttggaagaaaattgctgccatggcatttgaccttggttagcactttgttttttctgagagtttttttttatatatcatgagtatgtagaaacttctggggagcaattcctcagttgcctttcgagtcctgcccctaacccctcagtttgggctccatctgttgactgccctgggtttcagaagggagatagtgagtgtgctctcttgaacatggtcctttaggattaggcaatagagtggtaggctggtttagacatttctggttattgacaggccttactgcggcttcccccaaatgaatgaggaatatatttttctaaatccagccagtgagccaaatgagccacactgggataaactttgtttgtttacaaattatgtaagagaagggcccggccattaaattcttctgagccagaattcctagccctcttcaaagttgtaatcaaactaaacaaacactttccacaggaactaactccctcccgagaaacaggagcagatgctcctgggaggccttcagcaactttggaatgtttaaagtagaaatatgtaaccaaggtgaagttgttccagaaacattgcctgctctggccagaaccaaagcacgtgtcagcttttttatttagggcaagaggtgcagaatggactgggccagtccaggcagaattttctttagaatgtttaatttttggttttcatcttaacccggcttctcatagtatcagctccttgtgacctttattcccttctgcttaagtaactctttttttaagcttgatcttatctcttatcttttagctatgctggattacatccggggatcaaggagcccgcctcttaaagcactcaattattgtccctaggaaagatgtcagctgtagcacaaacactccaggggagggaggctgaggctcgccttaacttcattattgtctggataagatagggagaattgccactctccagttcttttggagatccacaaagaccgtccatctaggctcagggacacggttttcttttctttctttttttttttttttttttgagacggagttttgctcttgttgcccaggctggagtgcaatggttcaatctcagctcactgcaacctccgcctcccgggttcaagtgattctcctgcctcagcctcccaagtagctggaattacaggcgcccaccaccacacccagctaattttttgtatttttagtagagatggggtgtcaccatgttggccaggctggtcttgaactcctgacctcaggtgatccacccatctcggcctcccaaagtgctgagattacaggcgtaagccaccgcacccggcagggacacagttttcgaatccttgccgatttgagtctttactgagcggcttgatttatcttggcttgggaagttgtggatttttagaacattgggtacacttgtattaaaatagatgtatactttcttaagccaattgcacatttttctggagtatgcccaagatgagcttttctcaaggcatcgcctgaagaacagcagtcctgcacaatgttctgtggtgaaagggttctatgaggatctatgctatgcattaatggtggggctcagtatttgagaaatactgttgatcctagttttctcttagagatatattctgcacagtagtgaattaatggctctgagaaattctgttgaagagcggtctttcactttatttaatctggtacttcccaaatgtacttgatcacagaactttttctcaaaggactcaaggtgctaggggatatggagtggcgggtagccagtattaggttagtttagggtctgcactggttcagttggtgtcctgttagattatgaggatggaaggccaacaccaagttaactaccagctttccacagggccctgggatagagtcatcaccacctagaatgaatggcctgaacacctttgaactgtggtaggactatttcttccatttcagcttagatttgtggtcttctctataattgggtgatggggtatagggagttgtagtataaaagaaccaagaaacagtgcttctctttgaagaatttaatttctactggaatgggaagattcatgaaggagttaaacagtaccaccgtccaagtaggtatgaaataatgtcaagtagcctgtcttgtaggcattttgtagcctgtcttgtaggcaggtgggggccacaggaagcaggggcagcctttattgtgacttgacttaccaaactttgggtactgtgatggcgggcagataagatagaggagtccccccgacccctgcagccctaaatgcctcttcgtttgccccgcctctgtgtgtaatgtactatgtgtgaaagtctcttagactccccgcaaggtagacattttagagttggatgaaatgcatgataagaactccttctggtactttccagatgtatttgatcccagaactcctttttctcaaaggacccaaagtactggggaacatttggttccttctggaaggagaactccctctggctgatctgcaggcccccactgctgggttggcatcctggatttcgaggtggccaccttctgtgactcttaggccttgagcttggctatctggttttggagacctggtgccttggaagtgctgggctgagttgaatggaagtgcattttccgggttagtctaccttggttaatgcagggaagagtaaataggctctgctgactctagctgcccataggaaggatgtgtgtgacataagcggggctgagatatcccccattgagatgctaagaggaaactgagatgaggagtttaaattcttctccaaatatgtgtcatatttcatagactgttgacatagagcttttttttttttttttttttaaactttaaaagttggaggccgggcacggtggctcacgcctataattccagcactttgggaggccgaggtgggaggatcacctgaagtcaggagtttgagaccagcctgaccaacatggtgaaaccccgtctctactaaaaatacaaaattagccaggcatggtggtgcatgcctatattgtcagctactcgggaggctgaggcaggagaattgcttaaacctgggaggcggaggttgcagtgagccgagatggcgccattgcactccggcctgggcagcaagaatgaaactccgtctcaaaaaaaaaaaaaaaaaaattaggttaacctacctgatggatattgttggcagctgagctctgtctagcctgggacattcagccttttgcctctagctttcgatgaggccccaggctctgctgtgtattaatggtagggcttagccttagttcaggacccatcccctgtcatacccccaaaccccagaggggaggcgttctctttttgcagatgcagattatcagaaatcgttcttccttacactgaaccaaatttcttctgctccttggttctggttctgtcttctagagtatattaagtatcctttggttgctataacaaagtaccactggctaggtggcttaaatgacagacatatttactcatgattctgaaggctagaagtccagaatcaaggtgatcagggttgatttattctgaggcctgtctccttggcttataaagtgatggttttcctatgttttcacgtggccttccatctgtaactgtctgtgtccaaattttctcttcttataaggacaccactcatattgtattagggcccacctatatgacctgctttaacttggtcacctctttatagaccctctctctaggtagtcacattttgaggtactgggggttaggaccttaacatatcaatttttgagagacagaactctgcccataacacagagccattaagacatgatgaccctccagatttctgaaggtgattttcttgtcacttgtcttttccttgctgagaacccccagttctttccgttctttatatgagatggttttgaagtccctcaccatcttggaatcttctggacttgccttagttttggaaggacaaagtggaatactttggactacccgtgatattatagatagaattcattctaatgtctgcccaagcaaacaattttgatgatttccgaaaaagattaaaaggctaaaaatcagactgtacagtttcagtaacagctttaagatatttgtctttaattttgcctgagtaggtctgaccactgacacacacacgggcaccgcccccatatcccaccccatgcatccagtgctaactttatgtcttcttttgacttaagcatttacgttagagttagtaagtgctcaaggtctaagtttgttcaccacccttcctcccttccttcatacttttttagttttaggaaacctagttgggagggttatttcaaaagaataaatgaatgtagagatttttattttttaaatttaaattacatttaatttttttgagatggggtcttgctctgttgcccaggccagagtacaatggtgccatcacagctcactgcagcctccccctcctgggctcaagcaattcttccaccttagcctcccgagtagctgggactacaggcaggtgccactgtgcccggctaattttgtttatttttttgtagaggcgaggtctcactaggttgcccaggttggtcttgaactcttagactcaagggatcagactcagcctcccaaagtgctgggattataggcatgagccaccatgcctggctgagatttttattttttaaatgtaattgctgtctggagagggtagaaataactcagttactggagtataactcattttaggttcataatgtcatgccaacctgtagtgtagttagatttaaaattattagttattctcttcacttttggaaattgtttactttttattgcccttgtgcaccaaaaattgtgtcaaaaaagctcatatgttttgttctttgcattttcagcacttagcagagtgaaggttaaaaaaaaattgttgagtgactaaaggcatcctcttaatcatcttgtgcttatttaatcaggagcatcctgttgtgtctttggtagaattggcagcttggggtttagggattattctggccgctgtcccttttgcttttgaattgtggagctccccacaaagagaccctcagtgctgttcactcttctgctaaattgtggtttgtaagtcctgactgatagttttgacaggctttttctccttaccgtagtctctttagatggagtgtgacgctcttggagttcctttctttgaagatgctttgactataccgcccaggatttccaaattgtagcctttagatgcctggaaccctggccccacacagctgttaggccccctctattctggaggcccgacaacattaaaaataccaactatttatagcatacttttcagtgtcagtaaattataggatgcccttgccagtggatggggtgaacgctcatctgcctgccactgtgtgattgcctagaagcgtcggccaggtggcaggagctcagccccacctgaatgctcccaggtcctcacctggcactcccacaggaaactaaggactgccaggatgtcttggggttccagtagagtccatgtcctttgcgatggagtggttggggataaaacacacacacacacacacacacacacacacacacacgacactaggtatgtgtgctcttgagagaagcccattctgatctaactgccaactcctcaggaggctgtgttgtcagccatctgtgcacagaagtttgctgcatcactggtgagctggggagtgtcctgtgtggtgtccacttaatcttactaggaaggatcccctcatttcaacaaggtaactgaagaatgttaaatctaaatttgggtaagatatactctctgtaggctgaagaatttgaagagtatataaaagctcttatagctgggtgcctatagtcccagctacttgtaaggctgatgcgggaggatcctttgagcccaggagtttgaatccagcctgggcaatagtgagactccctctctttaaaaagaaaaaaagcttttaaaaaggccaaaaggacatagggtctttatcttccctcagctgccccttggaaaggatctcctggcttgccattcagagtacacagtgaggggaggccccctccacagggtaccatttagaacaggctcagtcgttagaacactgcagagggcgtgctgtcccctggccaccaagccaagttgggcttttggggacaggttttgtggtggtagcttttgggttcttcatttctttgcctggactgaacagtgagcagtgctcaagaggcctgttctgttagctggagtttccattgaagtgctaactgctggatcctttgaacctctagcctgggagggtatttataactagctgtttgcgtgcttagaggaactgaagtcctgcctttctgtagtggtttaagagctgtgcccttggtgtgggctgaaaggcaggcctggcgaagtgtggggactcaaatgcccaactccccacgaccttgtttgccttccccctgccctgccagcccagcggcccttttagggttaacttctctgctttggaagcagctggccagtttacactcctccctgggctgtacaaaaatacttcctttgaagtgttaggagaagcggtgaagggtaaaacctggtgaagaataaaacctggagtggggcttgaatgcatttctcttccagggagtttgctgggtgactgagccccacagccttcctcgtaacctatagagctgagtggttctcctcacatagttacagcttggagcctagttgcagctggcatgtgcatgtgtgggtgcgtgcgtgtgtgtgtatgcacacgtgtgtgtatgtgtatctgcatgtgtgcgtgtgtgtgtgtgtgtgtgtgtgtgtgtgtgtgtgtgtgtgtgtaaagtctcctcaaaaggagtatttcttttcaagagagatagttagaatacagccaccaagcttgcctggtggctggaatccctttgaaggcacttttccctagggcgggtctgagtcagggtggtatcctggggtatgtgcgaagctacaatgtttccacttcgtcctaaagtggccagccctgttcttgctccctactggggtaggaaagctgccactgatcccatctctgattcaggtcaaagcacagcagcctaaaagaacgctgggcatgaagtcagtggtgctgacttctcttaaccttgggtttcccatcaataaagttgggctggtggaaataccggattgggggcaccttgagaaagtgcaagacacttctctactgtaaagcctgcagttgagcagaaatggcatttaggataaagaggccaaagagaagaatgccagagcagaaatgagacggaacaaagcttgaatgtcttcttaatccttgagtatttgcagccaaggaggggttggggcaagatgggaggagaggcagctgttattttctagagaagaatgccaacctgtttctccccacagaggggaccacacaagttatttctgaactggagtttgcagtcccttctttcctggaaaatgccttcatatggatttcttacatcttattacactacttcctatctcccttagacaaggagtgtcccttagacagatctaaaataataccatagagctaacatttattgttggcttttgccaggtattgggttaagcacccaacattaatgatctcatttattcctcataacatccctatgctggttgctgctgttgtcctcattgaatagatgaggaaagggaggctggaaaaagtgagatgacttatccaaggtcctcttacctactgatgcaggtatggaaatacagacccggttagacttttagcctctttacttttttttttttttttgagacggagtcttactctgtcacccaggctggagtgcagtggtgcgatcttggctcactgcacctcagcctcccgagtagctgggattacaggcgcgtgccaccatgcctggctaatttttgtatttttagtagaggtggggtttcaccatgttggccaagctggtctcgaactcctaacctcaggtgattcgcttgcctcagcctcccaaagtgctgggcttacaggcatgagccaccacacctggccccctttactcttaagagatgtaagttacaataagcgatgagggggtgaaatttaattctgtgccccaaacctgatcagaagctgtttttaaggaaagaggtggaacattgaactctgttcattctggctgttttgactcatgttatattcatcagtggacttttattttattttttgagatggagttttgctcttgttgcccaggctggagtgcaatggtgcaattttggctcactgcaacctctgcacctaccctggattcaagcaattctcgtgcctcagcctcccgagtagctgggattacaggcatccgccactatgcccagctattttttttttggtagaaacggggtttcaccatgttggccaggctgatctcgaactcctgaccttgggggatccacccacctccccctcccaaagtgttgggtttacaggtgtgagccaccgtgcctggcctattttattttattttttgttttgagacagagtctcgctctgttgcccaggctgtagtgcagtggggcaatcttggctcactgcaacctctgcctcccgggttcaaacgattctcgtgcctcagtctcctgagtggctgggattacacgtgcccaccaccacgcccagctaatttttgtatttttagtagaaatggggtttcaccatgttggccaggcttgtctcgaactcctgacctcaagtgatccacccacctcggcctcccagagtactgggattacaggcgtgagccacagcacctggccagcagactcttattgatcagttatatttcaatacacatgagtgcgttttgccttgcggttactgaaaagaaacttttcttatttctcattctctgtgttgactttacaatagctatgcttttttccctctcattagaaagggttgggaagatggctgctctgtaactgcagctttgttacggttgaaggtcttggtgtcagggattgacgggtagcctgtaccccttggaatccttagctgtaggctttggtctttccccagcctagaaccagacttggcacttacttcaaggggcttgagatcctgtgcttgaccctccttagctcatgggggaaaccaaggcctgggaaagtttgagtgatttgcccccagtcacacacggggctagacccagggccaggctggcaggttcccagcccactggccacatgcttctccttttcacctgaatttcaaacaggagggaagatgaaagggatagaaatgaccagtcagaggagtaggagggctgtcatttgcaaacagtttcttttgatctttgccccattgtttaaaaaacccccaccaaaccacaactggtagcatcagcacatggttccctccggttcattgaggggcagtcatttctcttttaagtgggaagccccccccacccctagtagtctgtttcacttagggctccatacctcctctccccttctgctactcggctgccagatgtgctccccttcacaaacctttcagagctttttactgcttataggatggagtctaaccccgccttcccctaatattctaaagcccttgacattttgtgcccagtctgtctttgcattttggcatccaaccacagagccccttgcctctagtcaaagggctcctccgaatgagctttggcctttatttgcatctttgcccacattctgcccatctttcaatgctgctgcctccaggaagctctgttggactaatgcagcacccagttgcctctgctgcctccgaacctgaaacaatctggtctggcaactcatttgacacttaatattgttttgtgttgtttaacttgtagatgtgtctgtctccctaactagattgtaagttcactgaggtcaacagcatgccttctgaactgcttcgtattcccctctgaactgtttcatattcccccacagcattccacagggcctaggttgtatgctgtgcaaagatctgggactgaaatgctattatctttctaactgttaataggaatggaagaaattagtttccccaaaaaggaataaaatgattaactagagagatttttaataggatctgtgctacgttaggattaatatataggttgagtatcccttatcctaaatgcttgggaccagaagtgtttcggattttggaatatttgcatatacataatgagatgtctggggggtgagactcaagtctaaacatgaaattcatttgtttcatatacaccttattcacatagcctgaaggtaattttatacagtatttttaataattttgtgcatgaaacaaagttcctcttaagtacttatgtgtggaatttccacttgtggtgtcatgttggtgctcagaaagcttcagatttggaagccttttggattttgcgtttttcagttaaggatgtttaacctttactttaaatcgggttacttgaatgaatcagggaattttagtttgttgtaattatttttttgtttgtgtaattttgctggcaaacagtctatagtgaaaattttgacctagaccccttcaagatgaaagtaaataaatgcatgttatttaaaatttgctgttgttgctatttagcaccctagatgcctgtttacttttttactttgttgttcttataactttttctctaagtaatttcttggatccgtattcgcactgttacaattgtgttcttgaacatacttctaatcttttttagccattatgataatatattttgttttcttgaccctttctgtagtttgttaggttgatggcttccactggaattttaggtttgacctcccaaaggtggatccacctgtatgggaaagatttgttttcccttctccatcccctcccagtccctctgcgttctggccttgggtgtatgaaattctggccttgaacacacctagcagtcctggcccatgtccgtttcccagttaactcttttgtgcccgatctatatgtggcatgttccgccacagctgtgggtggaatcatgcttgtgcccccatataaccttttccttcttagcatttttttcttttcttactcctgagttaaacgtgtagcagaagaggtgtaaagacacagggccagcatgaatagtgctccctttttaaaatgtggaaaccggcttggagaagttaagtgacttatccaaggctgtacatccagtaaggagaaaaactggccttgtgacatagccccagggatgtgctgtgccccgtgatggccccatatgttggtgttgggagttcagtggctcatcaagtgcctgtagctcttaaaggaaaggagttgataaaatgaagcaacctggggcgcttactccaggggccatttctaatctgatttctgtaagtagtggatttttgagagtgggttcttgtatttcctcctggtctgctgtgttcatgggtatttttctggagagatggactctacatcccaaaactggtgaagatcccctgatagaggtgccgctaatgcccctccccatgcagggattgtactggagaagctgtgtctgtggcctgcacccctctggaagctccagtgagtgtcctggggacacattaggaaagtcagatgtgatctaccctcacacccgccagtctcaaacggctttttttccttcttaaaagtaagcaaggaataaactttaaaaatagcaaagggtcagaagttcctttttttttcaagcttttattataggaaatgttacatgtagactccaatagatagaacatgttatgtacacaccgtccctccatatactcaccatcacccaaaatagttgtcaacacctggccccgcttgtttcacttacacccccatgccaccctcatgttattttgaagcaaagccagccatatcatttccctgcccgtaaatatttctaaaatatctataaaagcttctttttaaaaaacatgatctcaaggctgttcccacaaatgttaagctagtgatgtcccctcccaaggggcaaccccacactccctgagagatggtgtatgtgtttcactgctcatgcactggcagccacgtctagaggctgggtctggggtggagcccaagtggggtgggggaccgagcgggcgaggccatggctttgcgctggccgggcaatcatgatgatctcggatcccgcgtgggcgctgtgatggtatcggctttgccccgggcgggaaccacaagatcaaaggcgccgcgcaccggggtgcttcaaagccagtggagcagcccggattgatgcccagaatgagagctctctgctgatgtaatcgtagcctgtgagacaggttctttttttaaatttaaacaaagacaccccttgtttgtttagtgaggtgaagcatgtgttgcagagggcacgcagcatctggagggctccactctggcctggtgggtccatggtagggcaggaatgctgcaagtgactagaattttcaggcgggcttgtagatcttccataaaagacaacctgtttctgttaagagtaatttttttctcccttttttagtatagtcaggcttgttctcaagtgactttcctgaaatactgaaagtgctttcctctggtggggttgtcaggctttggaacacacctggtgagccagctaggaattcagatcaaaaagtaggtaagcagccagggcatggtggctcacgcctgtcatctcagtgctttgggaggttgagaggattgcttgagctcaggagttcaaaccagctggggcaacatagtgagaccctgtctcttaaaaaaatttagctggctgtggtgatgtgtgcctgtagtcctagctacttgggaggctaaggtgggaggatcgcttgagcccataagttcgagactacagtgaactatgattgcatcacagtactccagcctgggcaacagagcaaggccttgtctctaaaaaataataataataataatttttaaaaagtaggcaagagggctgactttggtcagtcattccttgggtctagaaaggaagctcatctgtcccttccctagagtatgtgagaggcttgcccaaggctggtagtcagatcccatcctgttggaaggagagaggggtctccaagaatatggctgagtgccaggatcaccaccacccctagcctgaatattctcccagtctctgtaaaaatcatagacatgtggctgatttttctggggtattcccagttaagatggtatccctgcctttagtagttgatcagtacacaaatcagtgaaaccctgtaccatacatacctccatgagtgaaatcgtggtcatattctgttttcttgcttagcaaatcttgctgacagatagatgaagaagcctgccaaacggagtcagcttgttggatgctgaggtccttcccaagatcttccctacatcagaattcagggtcagtggggtctgaggcactactcaacttaagtcatagtgactaaagtccacttcagcatcttacagatgtcccaaccaaacccagcatgtgtaaaaccagatttctcttctctccacaaacctgtttctgttaggttcttttgttactccagctaaaaagctggtgtcattctaagctgtttatcctcaatgaggtgtccccttctctaaccccatgatgcctctacccatgcacattgaattgtctgtaagttactggaaggcaagactggaagggtttttccttcccttttaaactacaaaccaggtttcccccatcttctgtaaaagcaccccccaatattgtgaatttcaagcatgcaggaaaagtgagagttttgcagtcgacacccatatacccactatctatattccaccgttaacatttcactgtatttgctttcttacattttttatctatctgtgcatgtgatggggttttttgagacaaggtttgcccaggctggagttcagtggagcaatcatgaatcactacagcctcaacttcctgaactcaggtgattctcctacctcgtgatgggtttttgatatttgaaaatcaagcacatgggggctgagatgttataatggatgtgacagagtatgtaaggttccctttttaatttggtttctatcacttttagatccaggtctccccttctctccctatctactgcctccccgctaaccaacccctaccccatcccctggctgggaatagccctagagatcttgcgtctttgttcagacactcaagggagaacccaggaagttgcacctggaggaccacctggggcatggagtttgctatggagaccctgttgtgtttgaatgacttgccctctcacatttcctaaagcctactgcccttccttcatcttgtccctctctttgccttctagtggtctggccttgtggctacagtgagcatgtgcacattctgttcagagactgcagttttttgtgcaatggggtggaggtgctgctgcagagcatggagcaagccagctgggtgggacttctggtgggttttaaattgatttgaagaaaaatctctaaacagtattttgtttctttgattgattgatttttttaaagagatgggggggtctctctatgttacctaggcagacctcgaactcctggggtcaagtgatcctgccacctcatcagtctccccagtagctgggattatacacacatcaccctgcctggctttttttttttttttaattttattttttaaagtcaataaaataggccaggcatggtggcgcacacctgtaatcccagcactttcggaagctgaggtgggcggatcgcctgaggtcaggagttcgagaccagcctggccagtgaaaccccatctctactaaaaatacagaaattagctgggcatgggcatgcctgtaatcccagctactcgggaggctgaggcaggagaatcgcttgaacctgggaggcggaggttacagtgagccaagattgcaccactgcactccagcttgggcaatgagcgaaactccatctcaaaaaaaaaaaaaaaagaaaagaaaaggtgaataaaacaagtggctgggcgcggtagctcacacctgtaattccaatactttgggaggctgaggcgggaggatcacttgaggtcaggagtttgagaccagcctggtcaacatggtgaaaccctgtctctactaaaaatacaaaaattagctgggtgtgggcacatgcctgtagtcccagctactcaagaggctgaggtgggagaatcacttgaacctgggaggcagaggttgcagtgagctgagatcatttcactgcaacagagtgagacttcatctcaaaaaaaaaaaaaagtgaataaaacaagttacttttcttgagattatcaatgtaaacttgagttttggctgagtaggggcattccattggacttggcaaagtcagcttatctgaaatgttaacgctttcatagaaaggctttagcttttcttgtaaacctgctcaaagcaccgggcgtggtggctcacgcctgtaatcccagcactttgggaggccaaggcaggcgaatcacaaggtcaggagattgagaccatcctggctaacacagtgaaaccctgtctctaccaaaacaaacaaacaaacaaaaaaaacctgctcaaaggatccgggaagcccagaaaaatttgatttatatattaaatgagcatgttttgcaaagttaagatgagctacaacttgttgcacttagaatggctttatatgaactattttcttttgctttgctctgtatcccctccaaaacaaattaatatgtgattctgtgtgtgtttgtatgtgtgtgtaaggtcttttagagtagaagcagcattcatcatcttcgctgttgtgaacaggagctggacaggtctacaagctaacctgattcttagaacagactagattcacagaatagataagctctttatcacatggcagcatattttaattccagcctgtggcttccctccttacgggagctcagatagatttctcttttactgtgtgtgtatgtgtgtctatatgtgtgcatgcatgagtgtgcatctttagaagcatgatctgactttgcattgggctcctatggcttccaggatgccaagagctgtgactttagctacctgggtagtggatctgctgactgtgccttttgtgccagtgttgtgcctgttgtattttgctgtagctatagaaggcagctgcacaggctttaaataatgaagtcaagaccaccatctccagtttgattttgtttagagaccatttttggtacagtttagagccagtggataattgcaagttgattagtgtctcccaaccttctcttttggtctgtatttaatttttgcccaatcttttttaaattttatttttaaagtttttaagcccatagaaaagttgaatgaatagttagttgtgtgtggcaaaatgttaacagttgcttgatttgtgaattctctcttacatacacttagttttgattttttttacccgcgtttttactcactttttaaaaccacctttttaggccagactatttgaaagttgccaacataatggcatttcacaccttagtactccaacatatatacatctgctgagaccaaggatgtactcctaactgctgtgccattgtcacaccgaagaacttgacatatttaaatttctctgattgttccagaaatgtctttttttttttttttttttttttgacggagtcttgctctgtcactcaggctggagtgcagtggcacaatcttggctcactgcagcctccacctcccgggtttaagcaattctcctgcctcagcctcccgagtagctgggattacaggcatacgccaccaaacccggctaatttttttttttatttttagtagagacggggtttcaccgtgttagccagggtggtctcgatctcctgacctcatgatccgcccgcctcggcctcccaaagtgctgggattacaggcgtgagccaccgcgcccggcccagaaatgtcttttatagatggctttaaaaaatccaggacccatgcaaggttcccataaggtatttaaacttttaaaatatttatactgaatagatgcacaggtcctataatgctaacaagaggcaaaagacaaggaaagatttctctcacaattctactaccacagtttcaaaccaatttctttttcatctctctgttctttaaaaatgaagctttggacagattttctttagttcactttcctaaccatccatgagacaaaaaaagaacactgatcaagactgtggtgctgtttgactgcataagcacaaattgtggtctttgaaagttcttgctgagagatttggagttttattaagaataccaggaagccagcggcctttgagtaatgtttgaaacaagagggaagaaatcaactattgcttttgtttgttcaaaagctgactttattgatgatataacagtgtctgtaggtcttgggattcctttttccttattgtagacgtggtttctccaccttggcactgatgccatttggaactggataatttttttgttgtggctcctgtcctgtgcgttgtaggatatcgagccacatcccaggactctacccacaggacgccagtagcaaaacctccttcccagttatgacaactagaaatgtctccagacactgccagatgtcccctggttaggggcagggaggggcaaagttgacctcagttgagaactactgttctagaaattcttcaggactaacttaaattgagattgactgtgttactgataaatttctgcggagggacattttcttttataataagccccatcccaatctgaaaatccagaagtgtctagatgtccactggccaagggattgaaatcagttggcagatgacaactgagtgtgtgccttttcacgattttcacactttagcagaagccttgttatctgatactgttgggacctgtaggtggttgggtaattgaaaaaggtcagttaaattgaagcagggaatgatttaaaaagaatcatcttaagttttaattaaagcttataaaagggattcaagctcaggcctttgtgaataggaccacagatatgcactccttacattaacctcagccttgatgtatcgtttaaaacatttctctcagtttgagaaaaaatagaaataaaaaacatttaaaaagaaaaaatgaaaatgtacatttctgatgggttttttatttgtttgttttttcaaagcagaacaaatacgtataaacacttgtaaagctatcaggaactatctagaattttgcttttttttgtcttccaaagttgcacttagctctcaggtgcttttttttggtttttgttttttttgtagttatttgccttcatttagtctttctatccaaagtatattcaacttattttcatagaataaaatagtatattttgcattgtttaatattaaaatcagttacataattataggaggtgagtctgcataaacagatctagaaacacatatagctcagctggtgggagcagtggtgtgtggaggtactagagagtagtttcccagccaggagtctgcagtgcatgcaggctgaagttataggtctgctaatagcccctgccatattctgaaattcatggaaagggccccagaggatggttccgatttgagagttggaagattgggttcaagccccggttctgttgctttctccatggttttgggacaagcccatcagtaggcacaagcctcaggttgcttatctgtcaaatgggaatgatagtaatgcttgtcttgactacggagcaggttatcttgcaggttacacacaggccacataacaggaaatgcctttataaatgttccatggcgcactggtatgttattaatgagctggttatgctgagcctgagatgtgcacttctgagaatgtgttggctatcctttgctctttgagcacagagcacttgagcctcacagtaagagatttaggtcagaagaggaatggagggggccttgctcaatgcaaatttatacccactcttgcagaaacagctttgggctcctgccatgctgaaggtggaggcacatcacatggctgggtctttgtcataggttttgcttgagtggagattactggcttctcagtgataaacccagtgagcaggcagggggtgagaataccaagggtttggccagagtataacaggcagccaaggttctcattacaagtcctttacccatgctttgatgtgtatacaaagtgagtgacatcgtgaagattgtgccaccctggaggaaaagaagtagtcatttcagtgcaacactttagggtcttctggaaagtaagaaattatatttatttttgccagtatgcctcttttgttcttccagtgattcgtcagcaggttgactaaaattagagccgtctgctagtcttgtcccatctaatggttagataaatcttgcactgatgttcataccttgaaggacccttttttgtggaacttcatgtgttagagaaactgaacctgtgtaaaatggagcagatccaattgctctttgtaaccttgctccctgggcccccaaagaagctagaatctcccagttttggccccgtaggtgaagatgttactttgggagtacttgtgtaacctgaagaagactgaaagtatatagcagttctcatgagggaaaccctgggattattggcctaagtctctcttcagtgcagcagaaattctgctgttagaccggcattactgtcttgacaaaaggggaaacaaagaggctactacattgttagggagccccatccatctgtccacccatctgtccatctgtccacacacccatctgtccacctacccatccgtctgtccatctgtgcaacaatgcaaggtactgggaatattgcagtggaaaagacaaaaacccctgccctgtggagccaacattgtactaggcaaaccagatcctagcacattgtcaccctagaatcaggaggactcttcctgcccagttccactgggctagacatgtaaagagaatatgtgagtaatagctaaactttggtcttactcagctaaactttggtcaaatggcaaaatacaggtgaggttcctatggacagagaaggcagatggcataatggggatatgctgagctcagtgatgcatcactgtagacagcttgagaactctaggcatgggccagcttgggacagaggccatggaagagacaggtgtagtgcgtggcacctgtagctgaggcttagatgataaccttactctgctctagcatggagaggacccgttcagccacacctgtggtcatcattgagtgcctgtttgtaaccaaggttgaaaggattgaagaagaggtctgtgtgataagtgggaggtggaagagctgatggcttatcttagctggggaggctgttctgtctcctggccttggtttcctcacctgtaaaataaggccggtatctcaaaggtcacccaggttaaaaaaaaaaatcttaactttgttgagtaagaatgtaactggttgcctctttgatctttgatcagtgatccgcatgagtggagagaacctgacttttcctggtgcctgctgcctttggagtgagtgcaaaatgtccattttgctgatgacaggctccctgttggcatgtacagagaatctcaggcagtgtgagagtgtagtagccacctagcaacattgggtctttgtgcgcatgtccttgtgatctatcaccatgctgctgctcatcttgatctaagatgcattgccagtctgccctgcattgactcagctgagaggcaaaactgggcagaaaagtgggcttctgcaactggaaccccaaaagcctgggcagagctgacccgtattgccttgaatccttgtcttgggtgttactggccatggttggctctccttaagaaccgtcacagaagaaagtcaccaaatgtctgtctgcccatcaggagctctgcacttgatctcagctaaaaggctgagaagagattcatcaggagctctgtagccttcttgataccagcagtgaatctttaatacatgtcttctctaagagatactgtctgttctctctgatctttcccatgcccccttcctctcccttcttctaccttaatgaaagagcaaaacggctaattatatggaaacaaagattgccaaggtttgtattaggatgaagtgtgtgttccacctatgatagtggccaaatcttccaaagtacatcatctgacattttagaatacagacttccctttcatagcaaacctgtattttaatagcttgtggttttaaaaatatcatctaaactcatgaactaacgcattcttctcaattatatcccaactctaccatcatcttctctttcttctccttaacttctctggaaattattggaatctgcttttaaacactggggggattgtatattatagttgtttaaaaatgaatcaatttaagtttgagcaatgtggtaattcaaagcagttttaggtgttattgggattttttataaagagcattcctgagcctgaatgaagcagtcagttttcctgatgagccatgagcccattgcattaatgtttgagtctcctggtgctcatgataacgattaaggagttaatgttacctctgccatgtttaaacattaaccaaagggcttcctctgctattatctgttatcaacaattacttggaacattttctggcagtggagctttgtttttcctccgaggagatgctagaacaggatgagaatagacattaggccacatcaaaggaagattcttgattatgtccaaagaaactctggccttgtgggtacagagagtttgcctccttaatattttgtaaactcctatcacacccccacccccaccccaccccccccacacacacacacacacactcactctctctctctctctctctctctctcccctccctcctccctcctccccctccccctcatctgggtctgaggaagagggctgcagtgattatttcattgtatcatggtgagtggtacctcttttcttatttgggatactcattagagttgctcggtggagatggaatgatggtggggtgcagttaaacatggctgagtgctttctgcttaaggacctgatgtattaatgctctccaggtcattcatatttgggggaaggaacaaagagggtactgctctactgcagatgtgttcatttgcttattaacaaaaggctgggtgacccagaaacttaaaccctgagaacaaaagtactttccagcttccaaatgggaagatcttggagactcttgagtggctcctctggagtgctttctttaccacctagctgtttggagctgtcgtgcctaatagcttctcagcctagagggccccataaaattttagtctgtttctgtatagagtgctttggagtggccgtttctctctgcctcttatttactctcaaataccctttggaaaaagagctgatgaggtgcattgagacttggcatcaaaagccattcattgatagccatcgctcaactctcttggacttaaattttgttaaacaacaatcacaaaaagtcttaaagaattacccctgtttcccctgaatgttgaagtaagaaagaaaagaattactcctgtaatgcaagaagacatactcattaaaatctaaacagcgaaaaagtatatcgattaggttgggcgcggtggctcattcctgtaatcccagcattttgggaggctgaggcaggcagatcacttggggtcaggagttcgagaccagcctggccaacgtggtgaaaccccgtctctactaaaagtacaaatattagccaggtgtggtggcagatgcctgtagtctgagctactccagaggctgaagcacaagaatctcttgaacctgggagatggaggctgcagtgagccgagatagtgccactgcactctagcctgggtgacagagcaagactctgtctcaaaaaaaaaaaaaaaaaaaaagtatattgattaaaaaggggaaaccctcccatcctgttcttcctgtagatatcactgggaccagctgggtttccagtttttttttctgtgcatttctctatactcacacatggttttgcataaatgggattatcctatacacctgttacttgacttgctggcccaggacttctctgaatgtagggtatgctagatgcacgataacacagccccatcatggcttgtaattcaggcatttagcgtaagctgctgggtttcacttttcttctggaagcttcaggcattgccctgctttctggatgtgctatggttctggattcttcctttctttttctcttaatagggcttgtctaggatggaatttcaaaataacttgattctttccatctgagacacaagcacacaaaccctttagcagaaggtttttaaggttgcctgtgtacctgccctttgcccctagaggtcccactgtgagtgccccagtcacatgatccactctggccttatgggggcagcccaccctggcgcccgtgtggtgaagcctactcgttgtcaggtttccagtcattcctctctgcccttagccctgttgttctgtggctttgctttctgggtgctctgcccatgtcctcagttcatttctctcattccgggttctttgcctgaaatatcctcactaggctccactctttggggtcaagactgctgtctttgtgcacttggaggctagcctgtctctgttgaagtaatgtgtgggtagggtgcccacaccaacatccctgacacagatctggccagccaccttggatcagcctgctgccttctcccatctcctcttagatttgttcagttccaccctttattggctgcagaaaatgattctctacaattctttcactgtggtttatgatagaatccattttcttaaatctgatgtaggatcactttccccagcagcaaggtaattctcttagggtcttcaaaatggctcccctacccgaattcccgaccatcccactaactcagagggtggggagaggtgagtagatgatgcatttgcttcaagaagtgttgcctgtacttcccatccatcaccaccagggcatattgaacccctctggcaggctcttctggtgccctctgtgatgtgagaggagttcgggggtgcagagtgaacatagtcaaggtaatttaggaagctaagctctccatgttctccttggcacaggtttctctgagtcagttggtcactccctcccaaccgccatagttttgtttcaccttggggcttttattgtgaatctccacttacggtgctcctaacatcttgcaaaggtctttcagccataggtccctgatcaggaaaaatggtctcctctctgcactccagttttattctcctaatcctctctggctgagagtcctgacctgactcagccacgccccagagccagagccctggccacttttccagcttggtccatctctcatctctgcctattcagcctaggtgtcgtgaccatcatgcccacccagcatgccaccctgtgtggtctcctgccttgacaaggtgtgtcccttgccctggagtacatcagcaggcaaccctgactcctttcagctcctagtgccccggtacctctcctgggatcctgaggtccactctgctggatgccctggcagagcagcaggctcctgggagcacctgggattgtggcccctgcttcctgggcccaggaagtgccctgagtagctacttggtggtgggtgggttacttctgatccgtttatatttgctgtactccagcccaccttggttttttcatccacagagtagaaataaattaagtggctctaagaagtagtgattctttttttaaggttggatttctgtgcttttcttaaccatggctttcatagttttgctaatagacaaaaacagtccctcgactgcctctgagagtagagctgaaataaaaattctaggcgtcttctacagtagctggagtcctgcactgtccaaggagtctcagaatgtagtaggaggggaagaagctggggattatatatctacctggaccatggaacgggatcaaagaagggcattgagcggccatcccaaagccagggcttgtaacttaacatgacacctcattcatctgagctgctactgcatacaggtttaggattctttttaaattgtgcaaatgagtctctatcttttaaactcttagctgtcatgccctggctggtgctgttattataaaattgagactggaggccatacatttgaagacgaagacagtaatccgctgccaacctacttctctcttataatatatatatatatatatatatatatatatatatatatatatttttttttttttttttttttttaacaaaaggaaagaaaaaaactcatgccagacttgtttgtctgagatttatcactgtagggatcccagagacccccatggaagctggctttagtggtggctgcggctggggactggacagaacaggtcagtgtgagcttgaactagactgcgcctgcctcctggtgcacgtactgtgtttgggcatgtgttggctcttaaaatgctgttcatccatcaacatactgaccccttttgcaagtttcattgttctattattgtgactataaaagtggcacttgttacaaaaccagtttctgtgatctagaaccgtgttctcaaacttgcatctatcagaatcatctgccccacctctagagtgtctgatcagtagctttggggtggggcctgagaatctgcatttctaacaagttcccagatgctgctgctactgcagctgacctggcaaccaccctttgagaaccactgatctagaaggtacaaggaaatgaacatcgtcttcagtcttaccactcgggagagaaccactgttaacattttagggtataatgaatatattcatacatatgtggacatatttttaaaaacaatgatagttttgtgctgtacatagcgttgctttttaaaaaaacaaccttctttcttttggaatagttttagatttgtggaaaagttgcaaagatagaacagagggctcctgtatacccagcacccagtttctcttactgttaatatcttacactattatggaacatttgtcagaacaaaggagccaacattgatacattactgttaactccacattgttactgcttttattgaaaatacatgaatgtattttcataggattcaaatatcagaaatacataatgacagagtgcctcttcactcctaccatcccacttcctatatatttcagagtattttttatatatttatatacacatgtaattatgcacacacacccatccatcttattttaagacatgcttttttcatttaaatatgtcttgaaagcttttttttttcagtatacctagatctgcaccattatttttaatggacaacacattgttttacacccttttaaatatatcttatctattttaatctagcagattaaaggtgaggtctggcacacctcccttttatcttaaagtggaggttagagattatttgccctcctttgtggagtacttagcgtattctaggcactgccaagcacttagcgtgtattatctaacctagttatcaaaacagtcttactcataggtatcattatccctgttaacagatgaggaaactgagggtcagggaggttaagtgagcaaaaacttttgacgactttctagctgaagcaggctgtctctggtactttgggtgacatgagctgttcagcttagggtgaacattgcttggtttatggagtcttcctgagtgccacacctagtgccagaatatgaaggtgaagggtatgcttagggaactcacagtcttatagctgaggggagatgtatatataaaacaaatgattatgtgataagtattacattagagtttgtaagatgtaagatgggtttcggataccttaaaaaatccactagaagtaaggcatgtgcttggaaccatggcagaacagatggaagtatagcatcagatttggcaatcagacccgagttctaattctgaatattactgtttagctgtgtgactctagataaggcatttaacctctctgagtttttggtattaatatctcaaaataggccaggcacggtggctcatgcctgtaatcccagcactttgggaggccaaggctagcagatcgcttgaggccaggagtttgagaccagcctggccaacatggcaaaactccgtctttactaataataccaaaattagctgggatagtggtatgtgcctgtaatcccagctacttgggaggctgaggcaggataatctcttgaatttgggaggcggaggtagcagtgagccaagattgtgccactgcactccagcctgggcaacagagtgaggctctatctcaaaaaaaaaaaaaaaacaaaacctcaaaatatacttcatatgtttgttagggttaagattaaataaatacatataagaagtagctattgttgtgtttagtaaatatgtacatataatgtgtttagtatatttagcataaacgtataatctctgccacatcagttgctgagttgaaacctgcctttaaaagtccttggaaagttccggatagaaacaaggacagaacgaaatcccccggtcttttatctctaagaccaaatcctgaagccctccctgaaatcccctgtgccctcagtctttgcatcctcagagcattctcttaatgggcctcactcccatttacatgttatcctgtttgtgccgtctctcctctgcaagtactgtttctcggagggcagaatctgtgcctttcattcttgtgtcccctgcaatttaatggaagcacattaaatattagttgtagaaccagatgctgtagaaagggttcacatcctacaccccaagtcaggtggagcttacatgttatggtttttgaagagtttttttcacctcttccaaccatccttcccccactggttttttagacgttagcctttgacacccaaacttgagttttaacatagaagggccattgagcattttattcaaaaagatttttaatgaattatatcttgatatatgagtagtcctcattatgaattaacttaatcctcaggtctttcactgtgaggaaagatttatgttgatattttcccccaacttagaaaagcagaacaaaacctcagcaggcctatgtcttgtgtagccagggcaattcttaccagactgccacaggttagagaaaatgctgcccattcttttcctttcctgctcgtgcttagaggagggagcattctggcagggattctgggccagtgaaattggaataatactgtaaagaagttttggttgaagacaaggctaaatgaattaagggaaaggctagtttcttaataagtttctgagttcgtcctagaaagattggtagttaaaccatgttccatgtcaacctgaactgtctaaatagtaatcttgagaggtatggcagtgttattttttttctccttctggaaaatcagctaaacttgttagagtatgtgaaaatctactctcctagatttgaagagcaggattctttttggagggcagttacagagccacactaggtttctgctttttttttttttttttcttaaataggagattgctccctcttaagagagccaacgatttagaaaacttaatcacaggttcttcttccattcacacttaatctggtcattcagaggctcttgccctccccttcagaggctgcagcgcctgacctggggccacggaggtcttcctcctcaaccttcagaaggttcaaagggcaggagtgagtctgattctttggatagggggttgggttggatcttttaaaattaatttctgggtgtgaactgtaaaagagacgaaccagtagggatttactctcctccgtaatttactattgcagccagaagcctgatggtttcagcacccccacccagaaaaaaatttataaaatgaccaaaatgttacagaaatttatttcatggaggttgttcattttatggacagttgttccattttaagcactttgatcaccctcctgattccctttttttttcctccccctttttggacgtcagttctctggcatgtttagtgacagaagcaaaagggctgtaggaaatctttcttcatgtaaataagtacctatgtctctcctcatacttttattttcctctggcattaaaatgagaagagtagggtaggggacttggaaatcctatcactgcaaaaatggttggcttagatgccggtggtggtggtggcagccagggagggaaatcaagagtcctttgcatgtgcctgggtgcacctgcttgtttattagatgcgtggctgtaagtcatctggagtagtgcaaatttgtatttttattgatttgaattcagagaaggtttttggtcttaatttaactaatttatttatttttcattttagaaattcaatttcagcttcaccctaattgtcactactaaaatcctacatatgcaattctaagcttaccaaactgataaaataagatgactttattacttttattttttaaaatttctcgttttccttttctcttttccacttggctgaggacaaatatagataaaatcttggcctattgaagagccagtaaaatgttgttttatttttgtttctaacctgggatgttttatatctgcaaaatgtggtgaagacagacccattcattaaaaacagactgctcaactgggcaccatggctcacacctgtaatccgagcactttgggaggctgaggcgggtgggtcacttgaggcccaaagtcctcaagtgaccagcatggtgaaagcctgtctctactaaaaatacaaaaattagctgggcgtggtggcgcatgcctgtaatcccagctactcgggaggctgaggtgggagaatctcttgaacccgggaggtggaaggggaggctgaggtgggagaatctcttgaacccgggaggcggaggtcgcagtgagcagagatcgtgccattgcactccagcctgggcaacaagagctaaactctgtctcaaaaacaaaacaacaacaacaacaacaaaaacaaacacaaaccagactgcataagtcttcgacttctgaggtttagtctggaagaaatttctggtgccattttagttttgtcctgcacatgggatgtggttctttgatgcagtttcaggcctgaagccaaatgtgtacctctagcccggtgaacctctcacctgttttaggaaataattttgagcaaatcatactttctttgaggatctgaagtttctcaacaaagcttgtctgaagctatgtgatgtgacgcgatgccgatgcagagagcctggatgaggctgcacagatgtgcccaactgcctgatagcctgacttctctgaaaacctactaaaaccaacaggcggactgttctttttttggacaagaaaaaagacctggccctttcatatagcacatcaagccttggtagcaaccagaaactaagtgacaaatgcaagcttttagcccctttccttcttgtccctagaccttcatagttgtagcttgtcagtagaaagaactttggcctgggagttgggagactacctgggctccagattagctgagtgacctcgggcaagtctcttagtgtatcccaagatctttctccagagcgagagagtggaatttgattctctagcggtctcttaccctggaatcctgtatgattcttaggggtccgtgctacgtctgaggttagagatctcagatgtgaaagagactgtttgaggtgtccacttaagagctgcaaactctattgacccttgtgtctttcaactggaaaaatgagagcagcttctactcaaattaagaggtgccctcagattcccctatttagattctgtgaaccagtgataagtctcctcttctgtgtgattggtgttgcccttttgggatgtagacattttggactaaggatttagagatttttttaccgagacaggattgtatgcgtactaagatgtccttaaagctggtactttccccttttatcactaatggctgctatttccagagctgtgggctttatctgaccatcttgcaggtatgttgaaagatttgactagcacttaaaaggtatgttcagaaaatgctattttaagtgtttcttctttaccctatttcccccttgttgaacagtgcaaaactaccaggttttatgttccactgggcagctgctgctggtctgatgtttttctctctgtccctcctcctccttctgtctcccctcccccgggggtcctcccccagtgcctccccctgccccattcttgctccggtctgaagggagctgtacctttgtggttcttctgcagctgctggactttgatggggacatgcttgctgcctctacacttgcttcccttagcaaccgatcctttgacgatgacctcttgctgtttgcctgttgtctctcatgttggattatagatgagagatttaccaggctgggggtagaggcctgctgttagcacatttcttttagggttcccagcgtccctcagcctgtgttttctctctctaaaatatgaggtttggagagggtgcatgtgtgtttatgtgtggcggggatattagtgccgaatcaaacagttttaagttcatagggttgtcctagttgtgagctaattttgaagtagatgctgtggtggttactgaagctacttgatttacttctcatttttattataatgtgattaacacacatggggggggaggggtgccatttgttcctctttacactttccaagtgtttgtgtgttggcactaaacttgtttcctggtgtaatctgagctctgagaattgccaaattacctaaatctccacacattttaacacatttattttctcccaaagcattaagtttttgttttatttaaagtagcagtattcctggacatgtggctcttattttgcatggacagcttatgatgttccgtgtgtaactagtttgtgcatttctgtttagctcggtggatttgccttggacaaattagggacaaggacattgtgggacagcaagaattccaaaagaaccccggattaaggccaaaaaggaaaaaaaaaaaagccatttttaaagctacccaaagaggagagtctaaaataaaattagcaatcatttttataaaaagatacaagaaaatagatatttacacactgctggtggggagggtggcttgtagcagtacaatgtatcaagagtcttaaaaatactcataccccggctaggtgcagtggctcacacctgtaatcccagcactttgttttgtttgattatatagtctttgggggaacattttttttttctaagtcttcacagtttagaggagagctacttaaagatttcattatataaacttactactttggctgagtgcagtggctcacacctgtaatcctagcactttgggaggctgaggcgggcggatcacgaggtcaggagattgagaccatcctggctaacatggtgaaaccccgtctctactgaaaatatgaaaaatgccgggtgcggtggctcacgcctgtaatcccagcactctgggaggccgaggcaggtggatcatttgagctcaggagttcgagaccagcctggccaacatggcgaaaccctgtctctactaaaaatataaaaattagccgggcgtggtggcgcacgcctgtagtcccagctactcaggaggctgaggaaggagaatcacttgaacccaggaggcagaggttgcagtgagccaagattgtgccattgcactccagcctaggtgacaaagcgagactccatctcaaaaaaaaaaaaaaaaaaagattagcgggggtatggtggcacacacctgtagtcccagctactctggaggctgaggcaggagaattgcttgaactcaagaggtggaggttgcagtgagtcaagatcgtgccactgcaccccagcctgggcaacagagcgagactccgtctccaaataaataaataaataaataaataaataaataaataataataatactcatactccttgactcaacagtttttcttctaggagtttatccttaaaaaaagtttaagatgggctgcgtgcagtggcttatgcctgtaatcccagcactttgggaggctgaggtgggtggatcacttgagctcaagagctcaagaccagctagcaacagaatgagaccctgtctcaaaaaaaaaaaaaaagtcaaagatgtgtatctcaagacttacaggtaaggatgttcactaacatgttattcgtaatagaaaattactaacaatatctaacaataaagggctagctaaatgataatatttttgttcttatagtagagtactgtgcagacatctagattgtttgaggatacttaatgtcaggggaaaatgctcataagtgaaaaaagcagaatattaagcaatgtgtcatatgatcgtaatttaaaaagaaggaccgggcacggtggctcacacctgtaatcccagcacttggagaggccaaggagggtggatggcttgagcccaggagttcaagaccagcctgggcaacatggcaaaacccgtctctatttttttttttttttcttttttaagacggagtcttgctctgtggccaggctggagtgcagtggtgcgatcttggctcactgcaacctccacctctcgagtttaagcgattcttctgcctcagcctcctgagtagctgagactacaggggggcaccaccacgctgagctaatttttgtacttttagtagagacggggtttcaccatgttggccaggatggtctcgatctcttgacctcgtgatctgcccgcctcggcctcctgaagtgctgggattataggcatgagccactgtgcccggccccatctctatttaaaaaaaaagaattgtgtggcatacacagaaaaagaatgaaattctatccacaatctgtctctttggtaatgggatttttagtgctttcattttcttcatattccaagttcttcagtggtcaggtatcacagattgtgtatccttaatctgaaaatctgaaatttgaaatgcttcaaaatctgaaactgtttgagtgctgacatgctcaaaggcaatgctcattggagcatttcagattttcagattagggatgctcaactggtccgtataatgcaaatatttgaggatctggtcccaagcatttcggataagggacaccccagcctgtagttttataagttgagaaaacttttgttttaattgactcttcaccccccgaaaattattttgagaatattttgtctaaagctaaggacttaatagatgaaccaagacaatgacttttctctgtgtttcttcttgttgttgttagaatgtgtttgtgggtttgtgctttttaaaattaaagcccccttttttctttgtgtgagagatggctttggggtttttaagttgcagtgttatctgaaggaagttatatcgcttagcaggaactcagtacaataatgtgtcatccttctgtaatcatgtaatgatgcctgacttcaaaatgacttactagtatttgggaattggtgtttggactggttgtttatgagaaagtccaggtagaccgtccatttactaaatacggacgaatggcaagggacttgggagctttctgtttgatggtggttgaaatcactagttatggatgccatctttatttggaaatgtttgtaatttgggaagaatgagaagtgttagcagatgatggttctatgaacagtttgtctaggagcatcagagtgggaggagggtgttctggggactggggagtgggtttcatttgtgtttggcagtagctggtgatggctgttgatagttgaaagatctatggtctctgttgaggagtacttgaccatgaggttggttgagtgaggaggtgagtagctatgagatcacaacctgacaggccttacgcttcctcagccttcactgtcaacaattgcttgggaaacctgtaagaatggggagaagagaaatatagcagccatatcttgggcaggtattgagagggtagttcaaaatgttggaatatgggtaaaactagaatgctgcacttctattgggctcatcatttgggagagactagtgagggtagagttggttctcttaagttggtttagtcttttaacactttattttgaatcctttaaataagcacatatgggaatgcacaggtagatagaattttcttccactgataacttgctatcagccatgtattactgagtagtatttcattgtgtggatataccacattttatgtatccactcttcagtcagtaggcatttgggttgttttcactctgtttattatgaacaatgctgctatgaatgttcatgtacagcttatggacatgttttcatttctcttgggtatatacttaggagcggaattgctgggtcatatttgccactctgtttcatgtcttgaggaattgccagactgttttccaacatatctataccattttacatttcccatcagtagtgtatgaggattctaatttctccataccctctctaatacttgttattatttatattctttttattatggccatcctatattagcaggtatgaagtgatatctcattgtggttttggtttgcacttccctcatgcctaatgacgttgagcatcttttcatgtacttattggccattcatataccttctttggagaaatgcctgtttagatcatttgtccatttcaattgggttactcattttgttattgaatcataagggtagttacacttttaaagtgttggatcacaaagagatttgccatctgagaagttagaatcaaacatttaaaattcatttaagaatggttaaaaacacattacatgttaacaaaaataacttttttttttgagatggagtattgctctgtcaccaggttggagtgcagtggcgtgatctcgactcactgcaatctccgcctcctgggtccaagtgattctcctgcctcagcctaccaagtagctgggactacaggcgtgtgccaccacacccagctaatttttgtatttttagtagagacggggtttcaccgtgttggtcaggatggtctcaatctcttgaccttctgatccgcccaccttggcctcccaaagtgctgggattacaggtgtgagccactgcgcctggctacaaataacgttttttatttaaaaaaaaatttttttaaaaaagatgtggtcctgctctgtcgcctagactggagtgcagtggcacaatcatagctccatgcagccttgaattcctgggctcaagtgatcctgctgccttagcctcccaagtagctgggactacaggcatgtgccaccatgcctggctatttaaaaaaaatttttgtagagaccgagtcttgctttgctgcctagggtggtctcgaactcttggcttcaagtgatcctcccaccttggcctcccaaagtgctgggattacaggtgttggcccagcaagcctggcctaaaatatctttttgttttagaaaatatagtgagaaaaatggccttgttttatatatttgcaaatctctttaatgcctggcttagtaagacagttggattcttgcatccacttccgtacctagtctgttgcaatatgctttggttgaagtataactaagaaaatctagccttacacagatatgtagttggaaaagggaggagtattttatagcctgttaagatattagtaattatgagtattctttgatactatatctaaactggacaagaggtagtttctgaaagattagttgcaatgtagaatctgaaaccatgtcaatgaactattcctactgtttcactttgaaatctattggtctctgttgcattttgaatggatcttttactaatgaatgattttgtattatcatctcatgcattggtcatttagaaaatattgattcacttagtcatgtagctcttccaaatactaacatttcattatacagtacttaaaaattcacatttaattaattaattaattatttttgaggtggagtttcgctcctgttgcccaggctggagtgcaatggcgtgatctcggctcactgcaacctctgccttccgggttcaatcaattctcttgcctcaccctcatgagtagctggaattacaggcacgcgccaccacgcccagctaattttgtatttttagtagagacgggtttcaccatgttggtcaggctggtctcgaactcctgacctcaggtgatccatctgcctcggcttcccaaagtgctgggattacaggtgtgagccacagcacccagcctatttatttatttttgagtcagggtctgactctgttgcccaggctggaaggcagtggcatgagctaggctcactgcagcctctacctcctagactcaagtgatccttccacctcagcctccaagtgtctagggctttagctgcatgccactgtgaccagctatatttttttattttttttttatactgatggggtttcaccatgttgcccaggctggtctcaaaactcctgagctcaagcaatctttccaccttgaccccacaaagtgctgggattaagcgtgcaccactgtgcccggccaaaaattcacatttgttcccaacagaaaagtctctaagtatcaggattctgtcagactcatagtgataggtacacatttcccaaaagtttaatttttgcttgagagttcaagttttatcattggcaaaaaatattatcaattgtttccttgaagtgttagtctcatttcattcctttttgagaaaatgcctgccctgcactcatctatataactgtactttaaggtcagttactcgtttaagtaaaaatggtgttccgtgaaaaaagttgactagtttggcttacagctaacaatcacacaagtattttgtcttgaggcaaccactgtgctttggtatgcagcagaagtgctttatgcgtatttaaccatttcgccacgcagaattttttttttaatgtactcaagggttgagatttaataaacttaatagtttttattgcttcatctgcattgcttcatcaacattcttaaggaaacttttatttcaattccaagtatacaatgatcaagagtgcagtttggtgtcactgctgtaattcttgcaacagtttttcccaccactgcttttgtacatgaatcagtgcaaatgtcagcagactgtaaaaggctaataatgtctttgtgttattacaaaaatggttttgccctcacagattacctgaaaaggttgaaggacaaacctccacccaccgccccctgccctgggcttgcagatgggatgagaaccactgggctagacagcatttaatggaaatggggataaaattgttttgaaggtgcttgctgctctgttgtctgagactggtagcataaacttgcatggtgatagcagcaaaatgtgtatagtgttgtgtaccttgttgcgttgttctttccagtctttagcaatatgcaaaatcacaaagcactaaccactgagactcctttgaaaataaactgcttcctcattttcttcttcctttcctttcctttctaacaagaaaagcacctcttcaccacctaccttgcaaatgtgctgtttcccttatttcatgttttgagttttaaaaagacagtggctctttagggccttcctccatatctctgtttctgaggatactccttatacttagaacgcttgactgatgtctagttcaggcccaggccagtggctggcaatgacctcattcttgccatgtaaatccttactgaatggcatgagactccaacttagcagttcatggaattgtaaggtgagcccagtttcccagccaattatgactccatctaaagccgtagctgggccattaatgtattttgcgccttgtcctcttttatatcttgccaaactctgagagtctactgtatagctactggcaacaggcctctgccaaaacagtctatgaatgtatcattttacacctcatttttccttgtttccccctgtgatggcaccttgcctgtgtttctctctcccacatctttctacccacttaaaaaaattattcatttaacttattcctttattgtggtattatagacttttggcttctgtagttatttagtgtgaaagagatactgaagaatgaaaatgctaatatcttcttatagcgcccttcctttttcaaccactagtggttctcctaagggccctcttctgggttgaattgtgtccccccaaatttatatgttgaaaccctaactcccagcacctcagaatgcgaccttttttggagattgagtctttacggaggtaatcaagttcaattaaggtcgtcagggtgggccctaatccaatatgactggtgtccttattaaaaggggaaatctggacatatgcacacacaccaggaacgtgccaagtgaagatggaggcagtgattggggtgatgattccacaagccaagaaacaccaaagactgccagcagcccaccagaagctaggggagaggtgtggaacagattccctcatagcccccataaggaatcaaccctgtcgacatcttgattttggacttctagtctcaactgcaagatgacaaatttcttttttacccagtttatggtagttcgttaaggcagccctgggaaatgaataccaactcaaagctgactgctgtctcccatggccctgtggttctcttgctcaccttggacctttgttctacaggtcacaccacggctggtctcccagggtgacctgtgcgcctgccatgtaaggttcctcctcagagcagtgctctgtgactgctcacgctaatgaagaatgcaaggttgaggactgtgttttctggaaagatggatagagatggtttagggactcagagataggcgactccatgtacctgctcccatcccgtttgcatgtacctcttcccctgtgttgatgagaggtattaaaatcctgctggcctccacttgctcctcttccccgtggagcaaggagcactgagccagcatgggtatatctggctttcttttctccgagtgcattctccatgggaccctcctgcgggttcccagctgaccgctggtttgcaccacacagccaggagaagtggccaagaaaagcgagctgctggatggaatgctcagggccccaaaacattactcttcgtgatagtttggttcttgccaggatgtccttgtaaaacttttatgaagatgttgttgtacttgcattggaggttgaaaattgctgttaaccttgctaagtcccatgtcccccaggaatgtggaacgctatggaaatgctctggccctcccttctggacgggtgctccactgcagcagctgcctgcacagaaagttgagctggctggctggattaagggacatcagctaggcctttgtttaaaaatatttaaaatatgtttgaacctccctttatcaacaaagaacagtttctttcagcagagagaagtttttcatttccatgttttttttttttttttaaccattttgtttggttcttttgtatattagcaactttggaaaagtgttcccattcacagtttgaaagccaagtataaaaggtattgcatcgttattttctattttgcttaagagaaaagagcagtttgcttctattaagaacataatgtttatgaagataatcttctggcttgagttaatttttttctggtgtcgagctttgacagttaaaaagcaagaatgtgtttgcgaatgtatttaaaacatctctggaattaggagtttatgaaggtatattaggtaatgagaatgagctttggaagttacaaagaaataaaagaggttcctgtgtctgagtctgctggtatgagagccaggagtattaacctatggagagtccttgactattaggtcttttgagttaagtttcaggataaggcagcatttttctaaaatccaggttttcccttgcctgcctttgtgatgatcacagtgtgtatcaggtttctgcttaacttcagatcttctttgggtatcttcccagtgttattagaaacctgagatatttccctacttacttgcaggaggagccagcatgttgcataactgcaggggccccattcatcttagagtgtggattagaccagggtgtcaagggccctaggcagcgtgcagtgctatgtgcaggtgctagcagggaaggcatggtaggtgaaggttcctgtttcttgggtgcattaatatggaattacttttcaaaacgtatcctagccatacccttgttattccatgtttttaaaccagatcattcatcttgaggagtactcggccaactctaggtacggcttttcctccagcccctcagccactgcttgacagagttgtgaggccacagcctgtgagaaatcaatctggagaattattagttgtctcttaagttgctttaaaatcgcctggaggccaaccctgaagtttaggaaaagagtgtgcttgtgtttctcctgttgacttctttctcctccaagtgttcttgtccttcagttgactctggagactggaatatgagtaaagaacatgaaagggactttagttaaacattagaacctttcaagtttcagggcttcaactgagcttagtgacatgccatcaacgaccaaggttcccatatatcctgaaaggatatttctctaaggccagttaggcatcaatcattaatcagacactttacaaatggtacttatattaggttgaatcttatgaccttgccatttttgtagatcagaaattgttggatattggcagtttcccatggttttacctggagtactctggagaggccatgtagcattgtgcttcagaatagggacctgggacctgtgggccttgtgctaggctggaattttcaccttggcacttatttgtatgtgacactggacaggtcacccactgccattgactgccattgattgctctgaaaatggggcgattgtggttccacaccatagggttgtttttaagattaaatatgtccatgtatataaagcacctaggacagggcctggcacacggctcactctgtgtgtgttttttttcatgacttcttcattcttaggaccttcacagtttctgccatatctgcgtgccagctgtgtagtcattgtcttggtcagcacaggctgctgtaacaaaataccatggactgtgtggttaaacagacatttatttctcatagttctaggtgctggaagtctgagatcagggtgccagcatggtcgggttctggtgagggccctcttcctggctcacagagctgtcttcttgctgtatcctcctgtggcgaagaaagtgtgagtgagtgagcaagctctctggcatctcttcttagaagggtactaatctcatcatgatggccctgccctcaggaccttatctaatcttaattacctcccaaagaccccacgcatctccaagtgcatattgggggagttagggcttcaaaatatgacttttggggagacccaattcagtccacagcagtcatttatttagtgtttttctttaaaagtgacagtttttaaaacaggaataacttatcttgttgattcttggatgcttttcttgtttttgtatatcatctctgaaattagaatgtcttttttttttgagtcactctgttgaccaggctggagtgcagtccatgaccatggctcaccacagcctctacctcctgggctctagcaatcctcctgagtagctgggactacaggtgtgtgccaccatgcccaactaatttttgtatgttttatagagacagggtttcaccgtgttgcccaggctggccttgaattcctgggctcaagggattctcccaccttgtcctcccacagtgctgggattacaggcgtgagccaccatatgctgggcactgtgggataatatcttaaaatctgtgaaatgtcctggtttaatttttttcttgtccactaaaagatataatggctgatggcatcacaggtttggtggaaaatggtatttttggtgtttttttttttttgttttttttttttgagacaaggtcttgttctgtcgcccaggctggagtacagtggtgcaatcatggctcactgcagctttgacctcctgggctcaaatgatcctcctgcctcaccctctggagtagctgggtctacaggcacgtgccaccacacccagctaattttttaaaatgttttgtagcgatggagtcttggtgtgttgcccaggctggccttgaactcctgggatcactcaagtgatcctccttcaccagccttccaaaatgctgggattatggggatgagccaccatgctgagcccctttaaaatggtagttttttaaaggaaatattatcaagagtttgtgctagttatgtttttccaacccatgttaaaatgaataaatgtctgttgttttaaaaagtcctcctgtgtaccaccttgcagcctctgtggatcagcagtggactcctggcctaccctctgggaaacatgaatgtggtgtatagtttttggatcatgttttgtggagcagcatcctcactcagcatagctgtgctttggttggtctcacgcactgaagtgttacttaaggtttggattatgggaaggacttttactactaaagacgttggaaaaccatatgttttgggaggctgaggtgggaggatcacctgagcccaggagttcaagaccaacctgggcaacatagcgagaccctgtctctattaaaaaaaaaaaaaagagccaggcatggtggctcgtgcctgtggttccagctacttgggaggcctaggtgggatgatcacttgaacccaggaggtccgggctgcagtgagccaggttcacatcactgtactctggcctagatgacagagtgagaccttgtctcaaaagaaaaccacatcagtaagccatcttctcgtttgcctcactaacatcctgttgaggtgtcccacaaaccaaacaggatgtgggggtgcggaggattatcccctctaggagcaagttgccccatctggttgagggagaggtggttctgtcaccagtagagcatgttgagtgctgcagagatggctggcgacggggatgtctggcctggcagatgtcaccttcaaggagggagtgtgctcattgcaggctgctttctgggatgggagtaggctagtaatgtgatgtgtggggccttccctgaaatagaaggcactggacaggcatgtagtatggataaggtagagagggtgatggatagttttggctttccttgtgaggtgggcatgctggtggcatgttttagattttccgaatggcctttgtttccatttccttttttttttttttttttttttttaaagctgcatccttttgcatcgaatgaaaccccatcaagggcatctcctaactcttcttccattctcttgtccagggctggtgttttttgtgtgtttgtgactgacaatgcagcatggagaatttggagaagctagttttgccttttctcctacaggaagagggactcgtctgcaaagaaaggggtctgcctttcagtcctttgaagccacctggtctgacaaagacagtttccctgtccctttttggaccttgagctgagcaaaaaattacttagttgctgaaagcaggtcagtgtagaggacttcctctactcctgctttgacttcatctgcaagagagctgagaactgagtgaggcatttctgcttcttgagacttctcttggtgtggcagggcttcctgtccaggaggggctccattgcctcatgccctgggtataaacagtcccagagggctttggaatcagcctgggtcaattctggaggaaaaataaggcctaataagcatggctcttttcccaaaatgtagccacaggggtctaagcagctgattgtggggtccagggccaccaggagtcttggctggcctagcatatcttgatttgttaagaaggtggatatgaattcagtctagagaagataacgtgcctattgtgcagaatgcagggctttttgttcaaggctgtctccatttggaagtagaatgacaaagcagtgtagatttacacagagcatctctgagtctgttacaacccttaagttttatggtttcgagccaggacagtacttcttacattctgtctttgtcaagggcttttgtagtcctgagattttactgtggtgcactggttatgagatgagactcatagttacaaaattccaaactgaggattatcatctagaaccactccacagttggatccttggcctcactcttcactgtgtcactcacagcacctgtcacaatgcatgtatgttacccagagggtgcccagtaaatttactgaacgagtttctaaacttccaaattgctttctgattggataataatgacagtttttgttttgttttgttttgtttgagacagagtctcgccctgtcgcccaggctggagtgcaatggcatgatcttggctcactgcaacctccgccttccaggttcaagcaattctcctgccccagcctcccaagtagctgggactacaggcacacaccaccatgtccagctaattttttgtatctttagtagagacggggtttcaccatgttggccaggctggtctcaaactcctggccttgtgatccgctcgcctcggcctcccaaagtgccaggattacaggtgtgagccaccacgcccggccaatgactgttctttttgagaccttggacattacactgaatccagtgaagtttcttgagactgtaccgtgattaggggtgggaaataaatgttgtgtgcagttttggatctggagaactttgtgggagtgaagagccaagaaggatgctttgaaaagcataactcttgctgggcgcggtggttcaagcctgtaatcaatcagcactttgggaggccgaggcgggcggatcacaaggtcaggagatcgagaccatcctggctaacacggtgaaaccccgtctctactaaaaatacaaaaaaattagccgggcgttgtggcttgtgcctgtagtcccagctactcgggaggctgaggcaggagaatggcgtgaacccaggaggcagagtttgcagtgagctgagattgcgccactgcatgccagcctgggcaacagagcgagactccgtctcaaaagaaaagcataactcttctcttctgtccacttgttaataacagctaaggttgcaattcatggaacaatgagttttgtcttttctgaaacttagtaaccacttggtctatcaacaactatttgagtagtccactgggcaggcaataaagcagtgatcagtagatttggagatggataaaacagttggttttctctcactcccctcctttaggggagggaaaggtatatgatacagtgattaagagcattaactgaggtggcgggcggtgttagagtgtctttttgaacatgggtccagctgactgtttctttgggtctatgacctcctgagcccaggttccttatcatcccatggggcagtaatcactctcctgcccacctcacagggaggaagtggatgtgacctgaattatgagttgtaaagaccgaacactggaaatgattgccactgacggagagagggtataagagtggcccttttggagtacagaggacaccaggagcctcaggctcatgactggcctcatttggttctcctcccctccttgtgtaccaatcacccaaggaaggtgattcattagacttcattagacatacttcccagttcagcttctgtcttagctcagagtaaacaagtgactctctgttcagaaccgaatgaattgcatctggtacttttagtccttgcgtcttacagcaaagattaaatggtactctggaggcttggcaagatgagactcacttcatcagcagagaagaatggagtcacttgggagggagcacccgttctggtatgaaatttctcctgatcacaagtgcttgtgaaaattaaccttttgcatactctcatccttctcaaggaaaggctgaattgcttctcaagttttgtcctgcagccttgggtgagaattctggttttgttgcaaagctagagctcagaaacaagaaagtacaaggccatttttcttggaggaagaaggcaggcagctcagcttgcatgagcatctgacccagcagcccatggctccctttgtgggaagtgtccccttagctgtggaacccaggtgggtaggtgaacacctcaccttatgactgccacaccttatgactgcccattagctgctgcgcctcctctcctccttctcttttcttctgtctttctggaggaatagtctagttcgggttggagatgaacctctggcctgggaagacctctttcaaataagattatgcccatctgtggcttaagaagttactcattcaccaaggcacatgcttgtgtctagaagtaataccatcatgttaccacagtaatattaagtagaacatacacaagtgccatttttgtaaataaaatcaggaaactagccatttcatatggtaattcccagtaactcttgagaatcttgagttgtgatttctgtcatgtagacaagtatgatggaccgaatattcatttcatttctctaccaaattcttgtgttgaagccctaactcccacggtggtggtatttggtgatggggtctatgggaggcagttagggttagatgaggtcaagagggtgggaccttcacagtgggcttagtgcccttataaaaagggacaccagggagcttgctctctctttctccccttgtatgcacaaagaacaggtcatgtgagcatgcagggaaatggtggccaccacaagctaagagaagaggcctcagagtgaaacctgcctcagtggcaccttgatcttggacttcccagctccagaactgtgagaaaataagtttctgttgtttaagcctcccagtctagggtactttgttatgatagcctgagcagactgagatacttagttcagatagaaagtgagaagctaatttgaatatgttctttatctgttcttggcctgttttctttggtctgggcaagtcattttcaaggtgttctgtgaagttcatcttcatcagaatcacctgggaagcatgttaaaaaaccagagtctgggtcccaaccccagagattctgatgggagttatatgtgtggctggactgtgcatttttcgtttatgtttttttctttgagataaactttacatggagtgaaatgtacaaatcctaagtgtactgtctcatgggtttttaataaatgagtccctttgtgagacccaacccctgtcaagatagagaacaacatgaccatcagcccagaaagttccctggtgtcccttcccaatcagtccccactggggatcttcagtggcatcccagagctgtttgctatggtggcagtagctggagagctactgttaattaatttgagcaacagtgcagctgataaatttgatctagcagggaggtctgggactgccatcctgaactcaaggttctcaaatcctgtagctcttgggtcatattgataggggctatatttttaaaaagggatagttgggcagctggttggaaggaaatggcaatgagttcatctttgggcctgtttactgcccccttttgaaactgggtcgtttccagttccgagtggggaggctgcattgttgttctgagtctcagattggagcccattacctgccaggctcctgctcattcttacttcctcttggagggatccccagcaattccaattccactagtagggtttcccagccgatcactcttccctggctgttctcagtcattctaagtgtagaagctacatcatccttggcttctgcctagtggctcacttaaccacatcatctcaatttatcatgttgctgtttatctttttaacataaagttttattatgtgacatactatctcagtctgttccttttgctctaacaaaatacctgaaactgggtgattcataaaagaaatttatttctcacagttgaggaggctggaaagtccaagatcaaggtgccagcagatttggtttctgctgaaggctcactttctccttccaagatggcacaaaagggtcaactcttcttcaagaccttttataagggcactaatctgttcatgagggaagagcccacactgtctaatcacctcccaaggccccccacctcttaataccatcaccttgggggttaagttccaaagtgcattttggagggccatatacattcaaaccatagcacatgcattatctcatttaatccagagctattggttgacatcccatcccattgggacaagaacacacatgtgatagttgagcttaaagtgtcaaaatatggacagtattcagaggaaacagtgatagtgagctggagggttctagaaagatcatgtggaggcaatggggcaagagctggaccatgaagaatggatggggcagaagatgggcaggcaggagaatgggggataaggacctcctagtgacttaggtgaatttagtatgacatcttggttttattaaataagtagcatttgatactctttagtctactttaccttttccttccaacaactctgtgaattagaaagggcagatggttaaatctatttattgttgagaaatggaggtccagaggggaaaaaaatgctttacccaagacacacagtgaaattaatggcagcctgagcttctcaccgttgctatttgagtttctccatgttacttgaccacccactggtatctgaccccaaaagaccttccttgctgacttcctgtggtattttattttgttttgcacagcatggtactgctattaaaaactaaatcttttaaaaacaacatttcctcagtagcatcaaacatatgtctttatcttcttgattcaagctggtcctgactttaagatatcttgaggagaatagggtaagaatacatgtggactttcttccttgagaatatagggaagtattagatttcagagtctgaggttaacacagtggtcaccagcctaatgtggctatttaaatttgagttaattaagtaaaacttaaaattcagttctcggtttgcatttaccgcatcccaactgctcaatagcaacatgtggcttgtagctcctacattgctggtatagaaacagaacattgccattattgcagaatgttctgttggacagcactagcctaaagctgctgtctcagctaagtgacttctctgtaacctctgactctctgtaacttctaacttgtaacttctgtgtaacctttgaccttacaaggtaggcttggagtgcagaggggtgcaatgaagttgtctgtgatacttatgcttatctcaggccatactgtaatgttctctgggtcagctctccaaaaggcacaagcagtcacttgtttttcacagagagagaacccctgattctagctattatactgactctcgtagaggtgctacaggcaggccatgataggatctggagccactgtgttatcatttcttccatagttatagatggagtgctccatgtgtcattagtcatttacactgttgtgtgtgtcagcctcaatgtctacccatgaggatacatgcctgtatttggggaggtatgcaggggaggacagctgcagcccaaaaagctcctatatgaaggaatgagctgccatactgatgcctccattcttaagaatgttctgtgttgtggttgctggtctctggctgaaatttggtacgtacattctttagtttgcaagaataaaaggctcagtgcagtgttataggcaggggtctgctcttagttcaaatgcattgaaggaagccgttttatgcacagtggcttgtaccctgaacatccttttggaaagactaaacaaagagggttattttgtgacttcaccatatacatggcctgaatggatggtaagactgttgaatggaaggttgggtagattagagtgtgctaccaaaggcaaaagggctctggccaggggcccaatactactgtgaacaggatgcaaatgatggtggtctcacaggagacacactaaacggggagttgggtgggactggagctaaccccatttaaggtcctcaagaccatgtaatgaagcaggaaacccaacacacagagtgcatgaaagcaggacacagagatgaatcctgaatgggcagagggccccagagagggagacagtgacttgggttctttaagggctcacaggctatagccacaggctacagattcacctcattgcatcccctgcttctctgtaattgccctggtgagtttccaaatgaagggaaagagccaatagccctttaggaagagatgcactagatgaaaatcacctgattaaaatattgctgttaatcgcaggagaggggggtagggagggaaaaaaaccacaggctcaagcgttaaaagcaataaattatttgttaggctttgccacccagtatgaccttgggcaagtggcataagggccccattctctctgatcctggagcagggggaatgcctgccacctgcctacctcttgggggttttgggaggattaatgacataatgtctgagctgtgctttgggctccttggagacagccactatgtatcaggaattattagcacaagctaggacagtttcttgactattctttacctcattaagctacctatgcctgattacatctgcttataaaagttgctgctcaaagaagagtggactgggaaggtcataacccaggctggatctgtcctggttggtttcattaaagccactccctaaacccacactcatcagcaacagggcaccttgaaagcttagcacagtacccagcatctaatgccagagacggatggttaaaaagaaaagaaagaagaagatcctgtggactttttgcacttctgtgttttgtgttactactaccaacccacctacattctagtgcacctaggggagtgactgccaggttgccggggatgagggacaagctccaggagtcttcagctactcagtttttagaatgagtagctgtcagatggatggacaggttttttcagtgtcaaattttgaggcaaccgactaaagaaaccaggcggctctaagttcacataccaagaaacctatattgattgtgtttctaagtgagggcaagtccatgttgtatgaatgtgtattatgtgtaaaagacacaaaaaagtatattcagtgtgggtctctatcctcaaaggtcttcatccagttggataaatttgacatttattcctagaaagctcaccagccttgatatagaccaggggagaagtcagattaggggatcaaagcacttcaggtcaaaggattcagaggctgagcctgggccaggggcagaggggtgaggggaacaactcagccacaacatcctcgagtgtatccagaggccatgcagacagaggcttgaaccacagttcacaggaggctttcaggtacctgtgatcctcctggaacaggagaggacaggaagatcctaaggtacacttcaaggccatctcccacccacctcctatctcttgggaggctgtcgtgagacagtgtctcatcacccctcaggttctgatgaggatgaacttctgtactccagccccctcagaatagagctgcagaaggtaaagctgcttagctacagtctcaagtggactcctcagcaacagggcatcccgcagctcacgctgcggtcatctggccccttctgttccaaggtcataatttttggtatgaaggacaaagccgtggggagctggcacctttggctactctttcttttgctgtctatgtaagtaataaactgcctgaatccaaaagtggcttgtgatacctttaccagccgaattagtaaggtcttggccttgccttgtctcgtatgcttgaaaagagggtgtgcccaactctcacctcaactgcgccaaagctttaggccaaaaggatagagctggttcccagggcctgtcaaaagagaagggagcaggaccgagggcaaccagcaaagctttagacccatgcagaccagtgccacctggctcagccatcctagcacagctggaattctttccatctttgttgcatcagccacacacgaggacactaatactgacattataaggttgttgttaagattggagataatgtatgttatacttccatagccgtccccgacacaactactaaaacagaaaataacagccactaacatttactatgtgcttgcctcgttccaggcactgttctgctagttttataggctaactcatctgacccttacaactacctttgaagtagatattctttttttatgtagatgaggaagccaagttcagaaatttgctcaaggtcacatacaagttagtggcagagctgggatttaaacccaggcaggctgtgagcctgggttcttaaccaccctgcctcagtggacatcagccacgttcccacactttgctgctgaaaagaaagtaacattttatccagtctaagtgctgagaacagttctggtctcctatatcttagtatcaggttgagcctgagtagaaggaaacaacaagacagaagggctggcagggatctagatagagaagactctgaaagtgatgagtgatctggtttgcaggtggtagaatatgtacttggtttgtagttaaggagaaggacaaacttcaaaagctgtctcataagtcaaaggccccaatttaggaatacgcaagtgttggtaatacatttagccaaatgctggacagaataagctagatgtgacagtggacatgaaaatgccaaattcagaatggtggtcacattttgtaggaagagagagagaaatactatttttcaggctagtatttgatgtattgttactgttttatacctcaaccccttgatttcttgaaacagtgtaaacttggtgactttactgcataataaatccacccattgcacctacattgcaagcaaactccacccactccataaattggtgattttcccgctgcatctcctgtctactttcagatagttttcctaaagccctgactggcaaaagcctaattccgccctctgcaaagatctcaggtccttgtctaacgaaaggggaaaaacattaaaaatgaaatgtttgaaatgcaacagagtgaacagagtgaaaactactgcctatagtcatgtgtcgcataatgacgtttcagtcaacaacagactgcatatacaacagtggttccgtaaagattataatggaactgaaaaatttctatcactcagtatttactgtattttttatgttagtgtactcttctacttattaaaaaagaagttagctgtaaaatagtcccaggcaggtccttcaggaggtattcgagaataaagcattattatcataggagatgacagctcatgtgtgttactgcgactaaagaccttccagtgggacaagatggacacagaagacagtgacattgatgatcctgacattgtgtaggcctaggctaatgtgtgtgtcttaatttttaacaaaaaaagtttaaaaaagtaaaaaaaaaagttttgatagaaaaaagcttatgaaataaggatataaagaaatttttttacagctgtacaatgtgtttcttattagagtgttattacaaaagtcaaaagttaaaattaagtttataaagtaaaaaagttacagtaagctaaggttaatttattattgaagaaaggaaagtattttttataaatttagtgtagcctaagttacaggcacatagttttaaaaatcttttttttttttttttttttttgagatggagtctcgctctgttgcccaggctggagtgcagtagtgcagtggcataatctcggctcactgcaacctctgcctcctgggttcaagtgattcttctgcctcagcctcctgagtagctgggattacaggtgcctgtcaccacgcccatctaattttttcgtatttttagtagaaacggggtttcaccatgttggctaggctggtctcgaactcctgacctcaggtgatccacccaccttggcctcccagagtgctgggattacaggcgtgagccactgcacccagcctaaaaatcttttataccatattttttactgtaccttttctatgtttagatatgtttaaatacacagatatttaccatggtgttacagttgactacagtacagtaacatgctgtacaagtttgtagcctcagagtcataggctatactgtacagcctaggtgtgtagtacgctattgcatccaggtttgtgtcaccacactcttatgtttgcacagtgacaaaatcgcctaatatttctcagaacatgacccctgtcatgaggtgacacgtaactgtatttaggattaaggctttcagtgaagtagaaccgtggacagaaaagaaaagactacctttgaattgttactccttcacagatcatctgtcttctctgttagttttggaaacttgttttatcctgtattgggctgtttcactgcgacatacctaggggtgaatttatggatttaatatatcctgttgaggctgggtgcggtggctgatgcttgtaatcccagcactttgggaggctgaggtgggtggatcacttgagcccaggagttcaagaccagcctagacaacatagtgaaacccatctctacaaaaaaacaaaaactagccaggcataatgacacacacctgtagtcccagctactcaggtggctgaggcaggaggatcgcttgagcccaggggggttgaggctacagtgagctgaggtcgcaccactacactccagcctaggtgacagagtgacaccgtgtctcaaaaaaaaaaaaaaaaaagaaaaaaacacaactatatatatagtggagcaaagccctctgtttttgatctgaaaacttatgtcttatttcacttctggaaagttcacagccttcatctttctgaatagggttggtctgccaccactccaacacccttcccctggatagctatcaaagctgtgttagaggcttaggtctgccctctgtgtcactaactactatttttcttcttcctctactgcattctgggtgacttcctcagcatgtcttccagttcactaatcctatctccatctttgtccagtttggattatcatttaaaatttaatttcaatgtctgtttttcatttctagcatatatacattattcttttttaaaaatatccatgtattatttcctttctgcctgttgtgttttatatttccttattctttcttatagctataattcctttttgcatctcccataattcctaaaacatacatttaaaagtcattgtcaggctgagtatggtggctcaaacctgtaatcccagcactttgggaggctgaggcgggtggatcacctgaggttaggagttcaagaccagtctggccaacatggtgaaaccctgtctctactaaaaatacaaaattagccgggcatggtggcacacgcctgtaatcccagcgacttgggaggctgaggcaggagaatggcttgaacccgggaggcggaggttgccgtgagctgagattgtaccattgcactccagcctgggcgataagagtgaaactccgtctccaaaaaaataaagtcattgtcagactgccctattttcatttaatctcaaataaattaaccccccagtgtcgattttgttggctgtcttcttgagttagttttcttttggtattttggaaattgggtttggaaactcacggagtcagagttcgtttggaggaaatggtcttctctgtgccatccctcccccaacagccttgtgtttacttctccaaggacctgtaagcctataacaggtctcatagtgacatgtcaggaccaccaggacatacagacacagataaacttcagtcttcatacctccatgtggtcttggcccacatgcaggctgtagattgtacatgcttcttcgtaacatcctaggcttcactgtgagctgtaattgtcagatgttttcagtctcctttcatagctggggcagcctagcccaaactttggttttaagtaaggacagtggctcccatcccgccccacttgggctacttttagttcccagtccaccagaatagagctcccagcaccaccacctacattcagactcaaagcacagcgggactgtggcttcagcattcatctttgctttattctgttctgttctttttttcccccgtagatatgtttatcttgtttttaagcataatttacacctttcattttctttttgtatttgatgtttggaatggaggggagggaaactgaatcaaaaataaacttatacactgagcagaaggtgatatgtaaaggaggttaaggacagagtcaagcctagtgagggtagattattccaggcagagggaacaagagcaagtgcaaaaaacctatggtaggtaggcctggcatgtgggaggaacagcagggaggccagtgtggctggaacagggtgaacaagaaagagactggcagaagagaggggtcaaaggtcatggcaggtcagacacaggattttccagggcttcataagtcagctaggaagccagtggtaacttgcacagagtagtaacatggcatgacttatattttaacaggattgctctggctgctgtatttgagaaaagactggggaaggggcagtgtcagggagtggaagagttgagggagagcagttaggagctctggcagtaacccagaggagaagtgaagggggcttggtacagggtggaagcaggggaggtgctggaaagtggttgggttctgaataggttttgtaggtaaagtcggcagaatttgctgaagggttggatgtgggtaggggagaaaggaagcaaggatgactccaaggaatgaaatgccattacttgagaagaggaacatgacagaaaaggtttgttttggaggaagctcagttttaaacaatgaaatgaaaattagcccttcttacccgactacaaagatatgataattactgtaagattcaaaagaagactgaagactgttactcagaatatagaaagaactctgaaaattcaataagtacacaacccaattaaaagcaggtaaaagatttgaatagagactttacaaagaagagatagggatggcaaataaacacatgaaaagttgctcagcaacatcgggcatcagtaaatgcaaaataaaaccacaatgagatactgctacgtgccactagaatggctaaaattaaaaggctgatactaaaaagtgtcagtgaggaagtggaacaatgggaacccatacattgcttttggtaatccaaaatggcacagttccttcggaaaagtttggagtttcttataaagctcaacatacacctaccatgtgacccaggtattccacccgtaggtatttacacaagagaaataaaaacatttgtctacgcaaacctactcaaatatccgtggcagctttatttgtaatagtgaaaaagtggaaacaatccaatgtccatcaacagatgagtgaatgaaaagtggttcacccatacagtggaccactactctgcaataagcagcaaaacactgacacatggatgaacctcaagaacataatgctgaatcaaaggatccagggttcttcccttccccccaaaaaagagtgcatgatacatcatgtttccgtttatgtggaattccagaaaatataaaccaacttatatagtaacagaaatcagatcggtgatagtctgggtatggggtggaagaagaaatggactatcagggaacaagaaactttctggggtgatgaaaatgctctgtatcttgatagtggtggtggtttcacagatgtctgcacctgtcaaaactcactacacattgttatcagtaaatgattagtttattgtatataaacacctcaattaagtctgtgtttgttttttgggatgtggtggcacaagcctgtagtccccgcaagttgggaggctaaggtggaaggactgcttgagcccaggagtttgaggctgcagtgagctatgatggtgccactgtaccccagcctggacaatagagcaagaccctgtctctaaaaaaatgtttttttttttaattactgaattcaggatatgaacaatgacagcattcttaaaagagagtcaacaagtctaccatagagctctatgacccaaccaaaagtcatagtaattccagtgctgaccacttgattatcaccagcagcctcagttatgggcttttaattcataaacagatgacttgatgaagaaaaaagggaactttactcttctgattcaggtatggctaagaaccaggccatgaaacacccaaggacctaagacacaatgcccttttaagacagctagcatgaaagtggttcttttccatgcctcgtacgccctaattgtggtagaataaagactgacatcccacaggatgtaagacgtgtgtttattaaggacatcgacttgtgccatctcactcaggtggggctggcaccattcttattttacagatgaggaaacaaccttggggaaataaagtaattgcctggagtaatggagctcagctgcattcttttttaaaaattaaataagaaatttttaagagatggtctctctgtctgtcattcaggctggagtgcagtggcgccatgataggtcacctgtcaccttgaactcctgggcataagcaatcctcccacctcagcctcccaagcagctgggattacaggtttacaccaccacacctgcctaagtttttgtattttttgtagagacagggtttcgccatgttgctgaggctggtctcaaactcctggcttcaagtgatccccttgcttcggcctcccaaagtgctgggattacagggatgagccactgcgcccagcctgttcttttcatcacatgactccactggtgatagtcttgcctcactatatttttccttttctccccatttaccatttatttgcataattctttaataacagctttattgagatataattcacataccatataattcacctatataaagtgtataattcagtggcttttagtatattcagagttgtacaaccatcaccacaatctattttagaacattttaatcacctcagaaagaaaccctgtaccttttaactctcactcccctgtcttcccattcttctacctccccagtgctaggcaaccactgatcgactgtctctgtcctattctgggctttcatgtaatagactcatataagatgtggacttttgtgactagcttcttttactcagcatattctcaaggtttattcctgttgtagcatatatcagtactctgttcaattttgtggccaaataatattccgtggtgtgggttaaccacacttgatgtttccattcatcggctgatggacattcacattgtttccactctttggttattaggaatagtgctgctatgaacgttcatgtacaagtttctgggccatgttttcttttctcttgggtatatactcaggagtggaattgctgggtgtcatatggtcactctatgtttaagcctttgaggaactgccagactcttttccaaagtggctgctccattctgcgttgccatcagcagtgtttgagggttctaattattccacattctagccaacacttggtatgacatgatgtctcattatggttttgatttgcatttccttgatggctaatgatattgagcatcttttaatgtgcttgttgacatttgcatatctcttggagaaatatgtattcagatcctatgcccatttttaattgaatagtttgtctttttattgagttgtaaaagttcgcatacattttcttctgtgggttttatacctttaaattattcatttatttattcttagagacagggccttgctgtctccaggctggagcgcagtggagccatcatggcttaatgcagcctcaaacttgtgggctcaatcttcctgcctcagcctcccaagtagccaggattacaggcgtgtaccaccacacctggctaattttttaaacgttttgtagagacagagttttgctatgttacttaggctggtctcaaactcctgagctcaaataatcctcctaccttggcctcccaaagtgctgggattacaggtgtgagccatggtgcctggccttttttacactttcttgatggtatcctttatagcacaaaagtttttaattttgatgaagttcattttgtctattttttccttggttgcctatgcttttggtatgatgtctattgccctactttttgcatgagaggtacatgggcctctttgtatctgaacatcagaaataaaagcaggatgggcaggatcaggactgcccttcagatgaggttacatgactcttctaaggtcacacagaagaggcagtactgggatccaccgtgggccagtgcaactcgaagcccttattcatcatagcacaccacagcatagcacagcatcatcagggagtggagaatgagaggttctgccttaggcccttcactaaagtgctcgctcttaacactgtgttgagaatccccttctcagaatggttacttggcaaatgttgaattatttctttcatttttgtttctatgtttttccagtgaaagaaatttaaaaaaaagaaaaaggaatgaacttaaaatcttgactggagggtaatgaacctgcctctcaagggcctgccttcctttgcattcagaaaactactcaaggttacaaaaaaccaatacatcccactggttccttgtaagaaattctccaaatatcaggaaatattgtgggaaaggaatgcatctctctctctctcttttttttttttttttttttttgagacggagtctcgctttgtcacccaggctgaagtacagtggcgcgatctcggctcactgcaagctccaccttccgagttcacgccatcctcccgcctcagcctcccgagtagctgggactacaggcacccaccatcatgcccggctaattttgtttttgtatttttagtagagacggagtttcaccgagttagccaggatggtctcgatctcctgacctcgtgatccgcctgcctcggactcccaaagtgctgggattacaggcatgagccacgatgcctggctggaatgcatctctttgacaatgcatgttgccacttaatactgccatttgttacttttaaaccgtgttatacatagagccaattcatgggaaaaagccctggttagcttcaaattttggtcacctgtcctgtcagcagatgcatatacattttataattgttttcaaactcccgattaaacaacattacagtaaaggagggctcagctcttaatcactgttccttgcctggtgtccagccacaaggtcattgcttagcaaatgttgatttaaatgagtagtagaatccaaaaaagaaaaaatctcctactattcttactctccagtccattaagtttgtaaattctttgtttccttttagttttcatctagatacagatgtgatttttatttatttttatttttttgagacagagtctcactcttgtccaggctggcgcgccatggccagatcctagctcactgcagcctcaaccttccaggctcaagcaatcctcccaccttggcctctcgagtagcaaggaccacaggtgcatgccacctaattttttaatttttgtagagacaggggtctcactgtgttgcccaggttagtcccaaactcctgggctcaagtaatcctcccatcttggcctcccaaagtgctgagattacaggcagatatgatttttaaatctgtacattaatttttctgaaaattctgtacatctaatactatgttgtcttcattattatcttactgtggtgacattacatcccataaattatgcacattgtttttattatatagtctttgggggaactttttttttctttctaagttttcacagtttagaggaggactacttgaagatttcatcatataaagttactactttggctgggtgcagtggcttacgcctgtaatcctagcattttgggagtccgaggcgggcggatcatgacgtcaagagttcaagaccaggccaggcgcagtggctcacgcctgtaatcccagcactttgggaggccgaggtgggcggatcacaaggtcaggagttcgagaccagcctggccaatatggtgaaaccctatctctactaaaaataccaaaattagccgggagtggtggcggacgcctgtagtcccagctactcggggggctgaggcaggagaatcacttgaaccagggaggtggaggttgtagtgagccgagatcgagatcgggccactgcactccagcctgggagacagagcgatactctgtctcaaaaaaaaaaaaaaaaaaaaagagttcaagaccagcctggccaacatgatgaaacctcgtctctactaaaagtacaaaaattagccagacatggtggcgggcgcctgtaatccgagctccttgggaggctgaggcaggagaatcgcttgaacctgggaggcagagattgcagtgagctgagatcgcaccactgcactctagcctgggcaacagtgcaagactctgtctcaagaaaaaaaaaattactactttgaggttatttcctcggggtctgtttgaaaaatgaaattgtgggggaaggacataacggagcttgggcattgtctcattgccagaccgcttccccccaaatttgagccaatttgcagcatggccagaatgtgtttgcccaagttgggtttagagctggtttacttggctgattttgctgttgtattcatcaccaataagatggatgatgattctgttttcttactataaattagttgcatatatcccttaactctcagtcatttcattccttgcagtgtatctttgttctgtacctgctcatatggagaagttcaaaaaatacattagtactttctgccccactttgtcactatctagttcactaattttcctaaaggaattgacttagctcatgttgcttcatcatttataaacatataaatgaggcagaggttgcattgagcgaagatcatgccactgcactccagcatgggcaacagagcgggaccctgtctcaaaaaataaatgaataggctgggtggcagaggtgggtgggttacttgagttggatccaggagtttgagaccagcctggacaacatagtgagaccctgtctctactaaaaatacaaaaattagctgggcatggttgtgcatgcctgtaatcccaactacctgggggactgagtcaggaggaagtcctggctgcagtgagccaagattgtgcctctacacgccagcctgggtgacaaagtgagacccctgtctgaataaaaaataaattaatatagctttggaattttttttcacttatttttctagtttcagttcagcatcatgtagtttgaatgatttgttgttttatagtattgtatttcatcttaatttagtaactctttgatgtgtttaagcacctaatccttttcataataagaacgatcaaatgtcctttataagttgccttgcaatttgaagtaaaactgtgtgagtgaatttctgtgtagagaacaatacttgtcatctggtaggcacatgagtcactctgagtcacttcaagaatgaatttagaattaatttagcttaaggtttctatagtctactggatacttaaaaaaaaatttaacttacgaggcatcttatctatttgaaactagcaacagccattctaagtgagggtttgtaaagtcaggcgtgagatatacatggggccatatgtaagttttaacataattctctgacaaaatgaaattctagggcgtgggagatactcaagagaaaaggtggatttgaaatgccccctgcttccccaagtttctgacaggtcacttctcagttgtgcatttggtacagaggaatgaaataggtatagaggctctttttggtttttctcaaaaaaagtgatacccactgggggagactccagccgagtgttctgaaagccagagtcctcagccgagagaactccacagtcttcaggccgttcccagctggaattctctgtgaaacagcagcaacagccagcagctttttggtgtctggggtagtttctgacccatcacagttcccttcattgctatgacaacagggagaataattattcaggttctgtttgattctagatccagaaaaaggtttaggctctttgttcaaagagcaaaagaattgtccgtttctttgtacatagaagagggaaaaaaaatccttatgattcaagagaaaaatgggtgcgtctgtcctttttcctttctttcacgtaaattataagtcttggttctagccaccacaccttttaagaaaaggtctgggactgatgtgagactctgtaccacagcgacaccctaccctggccgacagtggcaaaagaacaaaaggaaggaagtttcccttttaaatccccaggaattttttgatgagataatattacagagtgaaatgtctcgtcctcctattagtttagtatttggcttctgtgtaacagtaacccacttagaagcaggcggctcttttgaagttattttaaactctcagcctagtgtagagatttgtaaccttggataaaagcaccactagccctagtttcagttttgccctttcagacatgtggaaagtgcaccagtatatctcaaggattttgtactgaaagcttcttaaagagctggtcttggtttcaaagtttggcttgatgtaccatactcaagggaacatagttctttttctccagatatttaaccttgtctgacatcgtcttttggcttcgaagttcccctagcttctttgtccattaacaaaacatgaaaccacatgaaaccatgatagtcagtctcactgggctctgaggaagttgaagaaagttcatcttcatatttaaacataaaaccagttgtttgatacctggtaccagagatggccaggtatatgcattgcttgttggtagcattttgccttagtaactattcagaaatgcaagtggaatgttgagttcctcttctagaggttatatctgtatctgggagaaaattggagcttctcagaacaatcaccctggttattgtgtctgccgtctctgtaacacccaaatctatatcacactctgatgccacctgggagctatttttggttgcgaagggtggtgaaagctgctggttctttctcttaccgtgtgtccctgagtcatccccagcccacgtcctggatggctcccagaacagccgtctcagacgaagtctcccttcagatgtccactcctcagtgcagggggcctgtggggtctctcttggtcctgatgaaatccttctctgccttttccagtgagaaggacccatagaatctgctggaacacttggagaaagggacttatttccagcagtgcataaaatttttgattaaaataattcacgtgtctgtttataaaaagacaaagcgtacatcatggtttataataaaaaagagcattatcttgtttcaccttcaccacccctgattgctattcccagaggcaaccattttcaattctttagtggcttcttttgtcttcatctctgtgattctttctaaatttctgtaactcttatagtcaattgcagaataatttattgacctcctcctgtagaaaaagattttgcttttcactcccctcttctcattcctgcattcttccaatgtagttatatcacataggtcataccctgattatgggttccaatcctggtgtaagtttttgttttttttctggagttaatcattgctcccctcaccctggccctccattactttagtttgctgtaactatcacgtgtcatcctcttgttcagaactataaaactctcctcagtaccatctaacccactgggtaatgagtcatatttttgttgttatttgtttggctgtcctgtagcctcatccttctggccccatctggacctgtcattcaacaggctggttgcaaagccatcgtcctgggatttctctttatttctctaatctgtgggagtccctgtgcttggatcccatgcctgccttttccttagttttatttctttgttttgttgttgctgacagcaactcctgaggttggacgtggatgggaaaatttgagacttgcttttttggggaggacatcttctattctccttccccttctactgtcctttcaaggtgctgtcatggtgaagggcaccagtgttgtggtctctgtgtatagaaagcagtagccaccccagcgttcttgggctgctgtggccccacagcaaggccaaggaggagcagcctttgctcctataccattgccagtaaatcttttttgtcctggaaatgtctttgatgactcagtaatcaataactgtaagagctaggtctttcaaagttcatgcagcaagttaattaaatcctgacctatttgccctggtccctcacttagcagagcagagacccaagtggctcagcaaaaacagcaagagacatggcagcaggcctgcctccaggccagaggtcatttgttcagccagcagtcatttattgagcacctgttgggtgcaaagctctgtgtagggtgaaaggggacttctgaataagactgtctttctagaagcaggtgcccatcttagaggggaggctgtaggaaccagtaagcaccatacaaagcatttgagaatcaaaaagtattagttcattcaagaaagctccgtggaaggggtgatatttaagttggtcttgaagggcaaagcattcaaggcaaaggcataaaatgcaaatggacatgacaggtctagagaaggtgaaggagagagctttcccattgatggaacgtctactggtgttactatgttgatgtattttatctcatttaatccttaacgatgtctgtatttgtccatatcagttaagacagatgctacagtctccattttacagataagaaaatccatatggaaaacagataggggcatagagtgtggaagtacaggcattggagactcagaagggtgggtggagggggggaaggggaatggattatgggaaattacttaatgggtaccatttacattattcaggtgatagatacactaaaagcccagatttccccactaaacaatatagccatgtaacaaaatcacacttcaatatatacaaataattttaaaaatcaaggtttatagaaatcaactcatctgcctaggtgatgtgcctcataaaaggcagaagtgagatttcaacacaagattgcatgatctcaaatctcattccttccttcccaaaatatcccttggaacaaaataaggagtgagagggtaagagccacagtttcataataatgtcaaactcttgataaaggagtgagtaggcattttccttcagttgacttaagcaagatgtcaagtatcccaaagttattgcacaaagagcaaaagtaaaacaaaatcaaagttataacccaggacatattttctgttatatccttgcactttcattgtagcttattaattatttgcatgaagttcttctgtgaatctgccccagaagtttttcttgtcttctcatttcaagccatccttccccttagtattctctattggatggagtcttggttccagtctagggtttccatgtctatttgatttttttctttacgttttcattagtagttcttgagttcttacacacaattcagctgtttttaatcttcttaaaaataataaggcaaaaacataaatgtcaagcatctgactaggaaagccctacccatccaaatattttaagaaaataaactcagaaatgcctataacttttaaatgcttatatgctacattaagttcaaagttaacatgcttaacaccatacacggaagtatcctacgatgaattttcaatgattaggcgttcagaaccacacaggtcttatatgtagtcagtgcctatatgtcgctggctagtgttagcatgtgtgaataacacgcctggtttttacctgatgactgcagggatggtgtggaagtagtgtctagctgaaactttgggagagtttaggaatttcttacagagaaggttcttattctctacagatgattgttatccagataaggaccttgggatcttttaaaatcagaggctaataattcttttttatctttttaaaaaaattgagatgcagtcttgctatgttggccaggctggtctcgaactcctgggttcaaaccatcctcccacctcagcctcccagtagctaggattataggtgtgtgtcactatgcctggtttagggcctagtatttcttaggagaaagtagaaataaaggtttcattggggctatatcttaaaaaataaaaatgaaagtaatggtttatatttaaattataattgcagctttgtactgatttttgagaataaacaaagattgaatctcttgtgggccatgcggggatattctcagcaaaactgtataagactgtgcatatagcatccttcacttaggtttgagttcagccgggtgcgatggctcatgcctgtaatcccagcgttttgggagtccaaggcgggtggatcacctgaggtcaggaatttgagaccagcctggccaacatggtgaaaccctgactctactaaaaatacaaaaattagctgagcgtggtggcgggcgcctctaatcccagctactcaagaggctgaggcaagagaattgcttgaacccgggaagcagaggttgcagtgagccgagatcgcgccactgtgctccagcctgggcaatggagactccgtctaaaaaaaaaaagttgttttccaactgagaggactctcactttttccaaaggtctctcttaatcctttgatcattctctgtggaagctcccatgcgtgtttcttcttctttaatccttaactagattgtttgccattggctttgagtggaatccagttgttgactaataggactttcatggactctgttaaattctgcattggttgctgatttgcagttctagtttgcaacttatttacatagtttagtcactatatcatctgatattccaacaattagcaggagttcactgttggattaaataagagattaaaatgtgtaaaccggtcaggtgcagcagctcacacctgtaattccagcactttgggaggctgaggcggaaggattgcttgcgcctaggagttcaagaccagcctgggcgacattgtgagacctgtctctacaaaaaaaaaaaaaaaaaaaaaaagtcaataaatgaggtggcaagattgcttgagcctagggggtcgaggttgcagtaagctgtgatcacgccactgcactctcatctgggtgacagaacaagaccctgcctttaaaaaaaaaaaaaaaaagtgttaacattgcagatgtccagttaataggaaaggcctctgtttcacttttcccataaaatgcaaatgaaatggtatgttcatttgcattttatgcctttgcctagaatactccatccttgggacaggtcagttccctaagaatattttcacataatgactacttctgcttctctataaaaacatctcctgagctcgtaacttggagcccttgggaaaagagaacctcagggtggaaatggctggaggcctagggtggccgatgctgtcgtcaggggccagctgacagagacctgaatcgtataatatgatattcaataggtgggtcaaaggagcctgttagattgaattaacagacttgcactggagatgtaaactggaataaggagctcaggagagagggaacttagggtggaagtgggaaggtggaatggatggtgaggtaagttttctatcctctgagatgtgatctcagtggcttctttaccctccacaagagggtaaagcgtccctcccactggcactttagaaaaattccttttagttttaaaggctttcattcctgttcagaagtcaatgcccttgacggggctgatgtgttgagctgctaacagtcacccatcccagtgtcaggaagatttgatagaggagtttggaggagagtgggaaggaatgactgcttaggaggggagagagcctggcaatgaaatgtggcccagggcaccagcctgacagccccgagggacccctgggtgtgtttgaggctttcatagttcagatttctgcatgcccggacacgctctccacatgcctttcctgaggccgtgtgttctgctcctccaagagagtaagcctctggcctggtcaggcccacttccacctcactggctgcagtgggtcaggcctcggctttggcttcagctgcctcttggtttccattccttgtcttctccccgtcctccacatctgccgctctcccaagccttgtcttttctccagctgccctcgactgtccctccatttctttctaccatggccttaagtctttgcgtcatggatgttcagcatttgcagacatttagctttacctcatgtcatatttactgtaggtttattgccatgcgtgtgtatgtgttctccctaacttagcatctctcaacgtgtgtcccatgaaatagtgtgatcagattaaatgcaaaacaagtttataaacaaagggtaggaaatggtggttttagcaaaggttaaaagcctttttaaaccattggccactgcagagctttaattcacacatgtagatcctgagtccctgtgaagagtttctcagtgttatttacttgtgcaagaacctgtttttcatcttgtggtaggtagtattctgcaggacccagtttcctgaagggctgctggaattcacttaggctctggaagggtagaaaccacattgtccttcactgtgggatccccgtgttagctgagggcagtgctaggcagggcgtaagtcattcctgagtaagctcttaggacagttgcttgttttttttttttaaaaaaaaccttttaattgtgaaattcatataaaattcaccattttaatcattttaaagcatgaaattaagtggcatttaatatgttcacagtgttgtgcaatcttcaccaccatctagttccagaacgttttcatcacccagaaggaagccctgtacccattgaacagtcactccttatttgcccctccctgctgcccttggcaaccactagtcttctttctgtctcaatggttttgcctcttctggacatgtaatggaatcatacaatatgcggtgttttgtgcctggcttctttctttagtaaagttttgatatagatgcaaagtcttagacccagatgatacctatgctcctccaaagcaactctttatcattggccaaaccccataaatgtataagtaaccaaaagcagccattcatctggaaacctccaagttgtgtggccaggttaaaaataccttggaatactggttgccgttaccatgatttgacctgggacttcaggaagctggctgagctgtgctggagtgagccgggtcttgagccctttcctggaggtcagaggtgcctgagctgttgacataattggctcatccctcttgctcatcctttttctagttggaggtctcagcatttcagactactcattgtttaataactgtagaacattctagagtgggctgaatcctgcacgggcaccctggaggaaaggttgccccacccatggcaccgcagaacctccattggcccttcaggcaaattccatgagcctgaaagtttgtgcaaagttagatcccagggccctctatctcatatcttggaattcccaaggggtgggatatctctcacccactataaagacagctgctggccgccctgtgctcagcagtggtgacctctcacctgccttatgagcttgtgcaacccctttcctgttgtttcattgaattgtcaaggaactctcatttttggcctgcaccctttgccctccactcgttgctgtctctggagtccaagaataccactgctccaagaggttacctgcctgcctaaaataacttctttcagtgcacaatcttctgcctaaggacctgtaatgctgtcttggtgtccagactccatcctggtttttgagcccttctctttccttctcagtgtagacagtgacccttcctactcatcagactggatgcatccttttctcccctctatatcatctcttagcaactcctccccgggcttggaactgacctctctctctcgttttgccctgatcagtctaactcttccttctaagctcactcgaggctcagcagctgcgcaaagcctccccaaacattctagcaactcttgctgcctgcaccaaactcatgttacgcttgaataccacaggatttagagctggaaactttttttctaaggattttatctcttagtctttccctgtcagatggtcagctctcagaggaagggaagataaagtaagcaagtggtggagtgggaaggcactggattgtgaatccaagggcctggtcacctctgggtgtgccacatactggctgtgtcttggaaaagccacttatcttggatttctgttctcatctgtaaaacaagtaggggataatgtgggtgtattagtttcctatttgctgctgtaacaagtttctacaaacttagtggcttaaagcaacacaaattcattctcttacagttctggaggtcagaagtcccaaacaggtcttcagggctacattctttctggaagcttgaggggagaatccatttttcatctttgtcagcttctagaggccatcgtcatttcttgattaacggccccctcctccaccttcaaagcacatcagcctctgcttctgtcatcacatctgttctccatctttctcatgcttccctgcttcccttataaggacctttgtgattgcactggaccaacccagataattcagtaatctgtccatctcaaactcaatcacatctgcaaagtctcttgctgtgtaaggtaacttatgcacaggttctggagattaggacatagatatcttgggggccatattctgtctagagtgcattcttaggtctcttgtgtttctaacttgtcatgaatctaaagacgtatttcttccacttatttaagagcttagcacacacagtgctaggcttatcagcttcttgataagttatgtttatccctgaggatttcctcttctcagattgttattagggattctagggcctggtaccactcagtgatagaactgtgagcacaaaccttagggttgttctggtttgactgcactttcacacacagaaatttgacactgcttatctgcccatctttgattttgtgctttgcaaattttgaaaagacctcaaagaattttatctgtttcccagtaaccaggggtagcctttaaacagcctgttaattacactggtgatttctgtggtctctgcatagagtccgggatgtgtttccagatcctcttgcgtaagttgaagtagacatgttgttgaagtctagaagccaaacaatcttggatactaacatagctagtctcgtctgtaattgctacttagtgttaaatttatggtatttcacagcaatttagattggcatttatatgggaattgtgctgttttctttccctagatcctattgggcagtttccaccttggatcaccatcacttacaaggcagtaaaaaagcatgcataacatacatttataatggctctatagtgttctccccagtgctcagctcattgtgctgaaataaaattccccttgggttgaaaaactgtccccactcttaaaattttaagttttgacgttacttttggctatagcatctgagaaatacacaatatgagtcaagcaaatgtgtagcttgcctgctgaagttttctttccattttatttcctagatgcacccactgggcctatgtaataacaatgacgaagaggacttgtatgaatatggctgggtaggagtggtgaagctggaacagccagaattggacccgaaaccatgcctcactgtcctaggcaaggtaagcaccaggcccttggaatcactgtgtttctggttggtgttttccactcttccatttcagcattcctcaaatagttgattatggagaagagccatgctggcacagtgctccttcccggctgaagttgcatgaggtggggactgagacatgccttgcagtggcccaccagtgtttacaagcccagactgaaagagactgccagtctcagagcgggctctaccctcttgtccattgtgtggccttgggcaagttgcttcccctcaaggagtcttagtctcttgtctgtgaaatgggctaataatagagattcacaatactttatcttacacccttgggccagatgtttcagaattctgagatttggggggtttagaaaggcattaaggggtatagattttatattaagtaacctccaagagacatggggaggcactcagtaaccaaacacattcacatttgtatagcaaaccatagagatcttcacattaagtgggataactaaaatctaaatagcctcgtgttagttcacggcagctttgcctccagatgagttcaggtccattaagttttgctgccaagtaagttatgggaaaatgtttcggttttagagctttttttggtttcagaatggcagacagcaattatggtcctgtattagaacttacctcataggtggttaggaggtgagatgagatgcaaacgcctcacacaagagtaagccctcaataaacgtttgctgccattggctaccatcactccatttagaagtactaaaaaagactttttagccaagagggtcagcattactttgactgcagtataagatagaaataaatttactttggaaagccactcatcaacaatcttaaaatatgacaggtaacaacctgttttaaactggattttgtttagactgcatcattttgttaaaaggagaggttcagagaaggtgatttgaattttggctgggagaaaggtagtctgtcctaaggatagtggtactgactggatatcttttatattctcaaaagctgccattctaggtaccatggggagagagctggggcaaaaaactgtcctggttcctaacctcttgaggctctcttgagaaatccaggagagacaaggggtggttttgaagcagggtgctagagagggaagactttccagacttaaagtagcccctgccagtgtctcctgaaagacctttggctccaggtaccctcacaggtctaatctttttgtggtttttgcatccctcttgtcttctgaataacttcaagtcacttgtcaagttctcctgccctttagttggaaaaaataaccccacaggaattattagctgtttgctttacagttcacaaagttgaatcgaggtgttttaggtggctcaggccctgatacttcatcatttaaataattggccagagctgcttagtggtggtaggagagcaatgacccccttgagaatattttagtgttttcttaggagaaatgccagctacatctacagggtaggaacagtgctttccttgtaggtgttacgctcctaatacaacattttctcttgtactttatgcaggaattggctccttgacttcatttgctttgccccggtctggtggggctccatctttgtgtctctcgcatctataaatgggttggaacagggattacagggtcaccctatagttctcccatggtttagcggtggggaaacttgctgaagtcactcagagaacccaactatttcctcctctgcctggaacaaccatgtagtggttttacttggagagttttgtatgatttggcctgctagcctgtgatgccagggggaataaaaaaccctaggcatatattgaatcattaagtgcttcttaagtttattcactcaccaaatatttattggatgcaggggcccagaagctgagcatgtggttctacctgcttgcaagcagcagcccccacgtttctctggagaggctggtggcgggcagcatttgcacatggttagtcattgcagtttggctttgagtttacacctgaataaaatcattagcacagaagcttgggccaaagaaagacagttttgcatttgtttaaagcctgggccagtgtaggaggtgcgatgagtcaagatctctctctcttcctccctctctctcctgccgcccctctttctctcatcatcttcttaaagtgtggttgttctcagtctcaatttcattaactttgacaactgcgttttcttgttttatgagccccccgggggctggtagcaaaaaaataggttaaaggaaggcaaagttatccccttgggcagcttagtccctgcagaattcatgattttccatccatttcttggctctgaagaagcaggcagtggacagaggcagaaaaggcataggaggaaaacagccaagctagcttgggggtgggagctccttcctgtggatgttgaaacttgttgaaaacccacgaagggaggactctgtccgctgcaggcgggccaggcattcggaaaagcctgtgggagaagaggggtggcctagacacaggctaaccccctccccaccacccaccctcttcacctacccgcgtacttacagacaatgccacagggtgaaaccttgaaataagagaggatgtcctaaattaaaacacgtaaatgcctctccaagagttcaaataaaatttcattttaaaagcaaaaggcataaacttgtcacctcagtttattactgagtgcttttgaacttctcagaaaagaactctataaactcatgagagaaatatgatttatgatcccctccttctcttcttttccattctgtgggaggaggtacagtcaggatcagctagggaggcagcgttgggatgagggcaagaccccacaggggagcagcaggccagggcgccaggccaggcccagcctcagaccaggcatgggcgcatctctccagctttctgagcctctctcctgtacttaatgtggagaggctgttgtgggttccttgttcttctaatattttgagcttctgtatcatatttaaaatctttctttgatattctagttcggagagattctagttacagcattgaaaaacaggctctgttacctgtggcagtttaagtcctaagaagttaaaatagaataaaattgacatttcttagagtttgctattaagtaagggtcttggccaggcacggtggctcacacttgtaatcccagcactttgggaggccgtgccgggcagatcacttgaggccaggagtttgaaaccagcctggccaatatggcgaaatcccatctctactaaaaatacaaaattagctgggagtggtggcatgcacctgtagttccatctgcttgggagtctgaggcaggagaattgctggaggtggaggttggagtgtgctgtgatcgcaccactgtactctaggctgggcgacagaggaagaccctgtctccagtcaatcaatcagtcaatcagtcaatcaatgtaagggtcttaaaccatccccaaagcaaaggagtctatgtttatgtcccgggcatcttaaccctccaattcaatcagtgtttattaagcatcttatagagctaagaattttgaaggttgactttaatagctttacctgtggagagtctcatggcagggaacatgagaggtgctggcgtttctagcaaagcctggttggccctgattctgtaactcaaggcagaataaatgccccataaccaccaccccatgttagagaagattcttagggagaggtttggaaaacagcatgggccaggcgtggtggctcacgcctgtaatcctagtactgtgggaggctgaggcgcgccgattgcatgagctcagggatttgagaccagcctgggcaacatggcaaaacaccatctctacaaaaaacacaaaaattagccagtcatggtggtgcatgcctgtggtttcagctactcgggaggctgaggtgggaggattgcttgagcccaggaggtcaaggctgcagcgagctgagattgtgccactgccctccagcctggccaacagagagaccctctctcaaaaaaaaaaaaaaaaaaaaaaaaaaaaaaaagaagaacagtatggtcaataggcatggccttagctctctccaaggcttaatagtacaatgtggggaaattgagaaaaagataagaaagggagtttcatgtcacagagacccagccttggctgactgacctcagaaagggtacttcattcagttctcggtgcattctcctctgtgcagcagggctaatgctgcctgtgtcattgtagtgggggctctgtgagatatttgtagagcacttagctcagagcctggcttatgggaaatgttggatgaccatgtagaagtcagccatcacatgttgggtgctcgccgagtgctgagagctttacctatagcgtctcctttaattaatgctaatttgacatcctatccagattcccattttaccataagcaaatcgagtcctagagagttctctacataacctgaaattgaacagcttacaagagccaagatctgaaataagacccttctgcttcatcaatgttggtttcttctctttgcctccttttgtcttcgccagtttttctagataaaaatcagatgctcacctgggcacggtggctcacacctataatctcaacactttgagaggctgagtcaggagagctgcttgaggccagaagttcaagaccagtttgggcaacatagtgagacctcctgtccacaaaagaataaaaaaaaaaaaataataagctgggcatggtggcacgagcctgtagtactagctactcgggaggctgaggcaagaggatggcttgagccaaagagttcgagcctacagtgagccatgatcatgccactgctctctagcctgggatatagagtgagaccctatctctctccctcttccccccaaccccccgccccggccccgcacaccaccccccaccccccggaaaaacgaaaaagaaatcagatgccttttagtagtcaaaggcttggttaaaactgttagttccacataatagaaactcagcctgagctctgttgagcagaaagaggaatttgctctgaggattctgggctatgtcacagaacccatgacaggggtgctgatgcccttccacagcacctgactccagggcttggatgccagcggccccctcctcaactcttctccatccacgcatctgctttattctctcactccccatttggtaggagacgcagccccccagtctccctgggcatgaactctctgggttttgagtctgaaaaattccagaaaagggattcattggcccatcttggatcaggggctcacacttaggctagtcagctgtaccctgggggctgtcctgccataggtggggagcaaggggaagatgtgttctccagaagagagctggtggggggcagtgctgggctgtcatcctcatagcaggcccctgcagtcactaaatcatatatgtgatcatgagcttgtgggtgatgtcctcagtctatcctgagtcattcagagaaggttcagctggaagaaactcatggtctatgtgtactacatagaatcaaatcctcttcttcccctgaacacagagagtgattgtggtgagtgaaaagtgagtccacgtggactggaggagttgggcaggttttacagagtgggggttgtgtaagacagacgtacgaggagacaggatgaggtaggaaaagaatctccagaacagggcagaagaaaagggagcaagatgttcttcaaggagcattgaaagttgctgctgaaggaagaggctctcaagtgaaagagtttggtcttcattctctaaagagctgggagccactgaaggcttctgacaaaagagcaggtgttgtagaatctgtattctgggaatgttcacttggcagtggcatctattctggttggagagagatcaagttaccctgccactagatgttttgaggaacccagtggaaccaggcatctgttattttaaatgctttagtggggctcaagcccggaaattactgagggctcttcatgtttgccatctctcctttctgtttgcacatttaagcaaatgtgaaatgtaggagcaacatgtccaacagcatgggaaggtggaaaactatgttgaaagggaggagagctggtttttaatcctggctcttctgataagcagcggggaaaccaaggtacgagaggtgggtggaaaattgaaccatatggtcagcccactaacccacgtccagccctcagtgtcttgggaacttctttgcaaagcacaaatacagactctggtaaccaaaatgaccagaagacagagaaccgagtcaaaggaaccttgacttttcaaagtgattgggagagggggagcatgtaagggttaagacttgggtttagtcatcatactaacacaggtttcaaccccagttctaacccttttctgagacagggtcttgctctgttgcccaggctggagtgcagtggcacaatcatggctcacttcagcctcaaactcccgggctcaagtaatcctcccacttcagcctcccaagtagctgggactacaggtgtgtgccaccacacctagctagtttttaatttttttgtagagacagagtctcaatatattacccaggcaacaggctcctagactcaagcgatcctcctgcctcccaaagtgctgggattacaggcgtgagccaccgcactcagccccaagccttctaagctctgtgagctcctgcagtcacttaacgcgtctgtgtgtttagatgggaatagcccctaaaggagataatgtatatcaagtgttgatcacattcctggcacaaccaaaagcactaaaccaggtgttgactcttattgtccatcttctcttcctttctctctccctcctttattgtccttcagttcctttctttttttttttttttttttttttttttgagatggaatttcactcttgttgcccaggctggagtgcaatagtgtgatcttggctcactgcaacctccgcctcccgggttcaagtgattgtcctgcctcagcctcctgagtagctgggattacaggcatgcaccaccacgcctggataatttattttatattttttatttttagtagagacggggtttctccatggtggtcgggctggtctcaaactcaggtgatccacccacctcagcctcccaaagtgctgggattacaggcatgagccaccgctcccggctccttcgttccttttatcactcaaagtggtattacttaaggagtcaaatccgtagagacagaaagtagaatggtggttgctggggtggggtatggggcaaggggagttgtttaatgggtatgaagcttccatttgagaagatgaaaaagtactggagatgagtggtggtcatggttggatgacagcgtgaatatgcttaatgccactgaactgtgcacttaaaaatgattacagtggcaaatttcatgttatgtatattttaccacagttaaaaaaacaatggtattacttaaatcatttcataatatatggaagttgagagcagtgggtataaaaaaaataagcaattttttccttaagcgatggagcatagttgctccaggaaagaagtgggtgactgatgttactgaatcctggggcaaagcaaacccgcatcccatagaatgttattcccaaggagtgttctggacaatctaggtacaatgaggacagagaccaaacccttctttgtgcatcaggatgccctggggaaattttctacttacttttgaagaacaactcccaaaatagagaatttcggggaagggaagacagacttatttgttatcctctcttcatgacaaagtggatggaggataggaaaatcaaactaattgaaatccaaggctgggcggggtggctcacgcctgtaatcccagcactttgggaggctgaggcgggtggatcacgaggtcaggagagccagaccatcctggctaacacggtgaaaccccatctctactaaaaatacaaaaaaattagcctggtgtggtggcgggcgcctgtaatcccagctactcaggaggctgaggcaggagaatggcgtgagcccaggagcttgcagtgagccgagatcacgctactgcactccaaactgggcgacagagcgagaatccatctcaaaaaaaaaagaagaaatccaaagatgtttgaatttcttcactaaatattagccagaacctgatatgtaccacagtgatggagtgtggttggtacttaaaggaaaaagaactcaggaagaatccaggaagggggcagtcaccttatgatgatgaatgggttttgccaaacctctcagaatttgggcttttgttttctgaccattgtctcactgagttctctgatgaaagtcaaagctcgtaaaattacagtgtaggtgttaatctagcacagcagttctcaaagtgtggctgggggctggtagggattctcaaggtcttttctaggagcacccacaggatcaaaactgccttttttttttttttccaagacaggatctcactctgtcacccaggctagagtgcagtgacactatcttggctcactgcaacctctgtgccccaggctcaggtgatcctcccacctcagccacccgagtaactgtgactataggcacatgccatgatgcccagctaatttttctatttttaatagagatgtggttttgccatgttgcccaggctggtcttgaactccagggctcaagcaatccaccttccttggcctcccaaagtgctgggattacaggcgtgagccactgtgcctggccaaaactgttttcatgtaatattattttgaaattatttttattttttcgaggcagggtcttactatgttgcccaggctggtctcaaactcctggcttcaagccatcctccttccttagcctcccaaagtgctgggattataggcatcagccactgttcccagcctgttttcatggtaatattgaagtgacatttgcccttttcactcttattctctcacaaatgtatggtgaggttttccagggacatcattgtgtgtagtgacttcatcactctgacaactaatggaatgtgtgcttgcatattctgtgttttaaagatttctcagattataattcctaatttggtaaatatcaatagatataaccaaatcagaagttcttggggttcttaatcatttttgagaatgtgaaggaggtctgtaatctgagttcattgagctggcattatggccccactgtaaagatcatctcagagagcttagctgggttagagaaacccttctataaaatcagtggaaatgaacagaaactagaggacaatacagggagtaaaggtgaactattctgttctgcagtactggggccaaaagaatgttggttctgaagtgttagtaatttgagtaaaaccaatgggttgcagttttccacatttaataacaaacaaccagacagtgaatttgaagaacctcagcgaagaagatctgaatatctttgctgcttgcattgggatataaccttcaaccttgacgtagaacagggcttacctggatgggtctttacttgagacaggaacttgggtaaagctacagagttttttataagccatgtagatattgtggggatgaggggccttatccttccgcatgccatcctcattggggttttgatcacagatctgtatttcctgggatacctgagtgccctcggctttaacccaagttcagcttagcactcctgagtggtgagattctcaacttaagagggacggttgggccggaatccttgggtctgatttgctgtgggaaggggaggaggctaactgtcccatggacctggtcacagctgttccacatcataggtcttggcctcaccaggccttctctggtcagtgaaacaagtaggtatttgtcatgtacctgagcacggggcatactgactattgcttattgccatggcatccctggaagcacgctgcaactatttgggactgacggtatcgtaccttccctggtcctcttatcacattgtttccaaacgggggcaattttcaccccaggggatacttggcaatgtctggaaacatttttggtcttcaaaaatgtcagggttggggggtgggagtgggggtgcttactggtatctagtggagttccccttcctccttcattcctttctctgccccattgcctgccatgaacaacaggttcctggtagcctttgtgctatggttctgttgggaattggtgctctggcacattcctctctccatctgaggagtgtgaagagcctagatcttaaagctgaacagctgaggtgcaagtgatcgttctgttcagtaacagctgggttactttgggctgtttaacctctctgcctccgtttctccataccgcctctgtaaagtgaattctgataattaaaaaaagaataaagtggctgggtacagtggctcacacctataatcccagcactttgggaggcgagaggataacttgaagtcaggagttccagaccagcctgggcaacaagcgagaactcatttcaacaaaaaaacaaaaaaatagctgggcatggtggcacacactgtagtctcagctactcagaaggttaacatgggaggatcatttgagcccaggagttcaaggctgtagtgagctataatcacacaactgagagtgagaccctggctctttaaaaaaaaaaaaaaaaaaaaaaaagtatgacccaggcacggtggctcacgcctgtaatcctagcactttgggaggctgaggcgagcggatcacctgaggtcaggagtccgagacagcctggccaacatggtgaaatctcgtctctagtaaaaatacataaattagccgggcatggtggcgggcacctgtaatcccagctactcgggaggctgaggcaggagaatcgctggaatcagagaggcaaaggttgcagtgagccaagatcgcaccactgcattccagcctgggcgacagagcgagactccgtcaaaaaaaaaaaagtatgtaaagttcttggaatatgtgaatactcaacaaatatcactatcaatttctaaacatactgctaccaagcagatggaagtcccttttctaaggtgagcaagatgggtttcttgttgaggaggaagtttggaaagctcttcatatttattttaaggagcacttgggtagctatctcctacatttgattaaaaccggatgcaagcaagaaacttagtaaaggaaatcagatcagaaagaaaagattggcatgatgtaagtggaaaaactcagggaatacaagttttcttctaaggtcatatgtatgatttgaaagtcacaaaattttaatttgatgcttttcatctacaccacctaaatcttccatgaacctcttggttaaaaggctatattaagcacaatacttttaaaaaactagatcagagacatttttagctataaaaggctaactgaaaccattatttgagatccactgggaggcttaagagagttttgaagatagagtgagttaacagaacaaataatgtgtctgtcaagccaaggagcacaggcggctggccacctcccaggactgggggaagcctagctctagacactcctccctgccactgtccccatccattgaaccaggctcttgatgcaacaagggtcacaaatgaggctaaatcagagaactagagatggtatgactggccagctgaaaagcccatcaaaaatagctactgaagccgggtgcggtggctcatgcctgtaatcccaacactttgagaggcagaggtgggcggatcacttgaggtcaggagtttgaaaccagcctggccaacatggtgaaacctcatctctaataaaaatacaaaaaaaaaaaaaaaaaaaaattagccaggcatggtggtgggtgcctgtaatcccagctactcagaaggctgaggcaggagaattgcttgaacctgggaggtgggggttgcagtgagccaagatggtgccactgcacttcagcctgggcgacagaacaagactctgtctccaaaaaaaaagctattgaaaaaaaattagctgggcatggttagctacttgggaggctgaggtgggaggatcacttgaggctgcaatgagctatgattgtgccactgtactctagtctgggtgatagagcgagacccctgactctcaaagaaagctactgaacttgtctacctttgagaggccattttgaaggatagaggaagtaccagtatcgggtcagttggccagaatctctcattcctggagacaagcccaaaagtcccatctgctttttgttctcaaatagagaggcctcatatacatctggccatgcacatacgttatgccagccacaacagtgggcagtcactcgagtgcgttgcaggttgctggggctaccatgacagtgactgcacatgattggttttctgtctacgaagctcccagaaaacctggacatttctggagttccccctccctttcagtgtacttgtatagcacctgtgcaggagagcaccacacccctaacctcggtgacataaattctcactgaatgtagagacagaaggaaaggggacggcagagaaagcttgtctgtgagccttggtcacaagacctcagactgcagagacatgcaattacttttcttctgtcctttgtgtttccaaaagcaccatattttatttgataaaaggtacaggggaccattctgcttttgtgatgttgttttccaaatcaagcatcaggctctctggtctgagtaatgctttttgtgctgagtattaagtttgagacagtctaaacaattcctttgggggtactgaaatactttaaattttgcatcatttttgctagttataaaaataataaaagagtttcaacacattccatttgttctaagcactgttggattaaataaaattctggtcagcctgaagaacgtgggctatttcttgtgctatatataaaggtatgtggtctttactatttcacattaacctgttgctagaggttttcacaaatgtatcaattcacaaaagaacctcagagaaaagaatgtgaaatatgctaggaatttttgttaaccttggcttgatttttagaagttaaattttaaaatgttttagctttagaaggttcttttttcatttcttagtaaacatagtcattttcttggtgttttctaattttttaagttttaattgatgaaatcttaacatcttttagaacctaactgtaaaggtgtagttacaatttacaatttatagcatcaacttaatcttactatttcagttactgtattattccatttgcattactctaaggaatacctgagactgggaaatttataaagaaagaggttgaattgacttatggttctgcaaggtgtacaggaagtgtgttgccagcatctggttctagtgagggcctcaggaagcttacaatcaccacagaaggcaaagggggagctggtgtatcacacggcgagagtgggaatgagatgggggtgggatgcttctaggctggggtgcagtgatgcaaccatggcttactgcagcttcaacctcccgggatcaggcgatcctcccacctcagcctcctgagtagctgggactataggcacgcccaccacacccagctcatttttagattattttttgtagagagaaggtcttgttctgttgcccaggttggtcaccaactcctggcctcatgatcctcctgccttggcctcccaaagctttgcctttttttttttttttttttttttttttgagatggagtctcagtctgttgcccaggctggagtgcagtggcgcgatttcagctcactgcaagctccgcctcctgggttcacaccattctcctgcctcagcctcccgagtagctgggactacagatgcctgccaccacacccggctaatttttttgtatttttagtagagacagggtttcaccatgttaaccaggatggagctttacctatttttttaattggcgaatttttccttttattattgagtttattgagttatgagagttctttactctagacataagtcccttattagatacattatttgtaagtattttctcccattctgtgggatatcttttcactttcttgatgataacctttgcaacccaagattttttaaactttttttttttttttttgagatggagtctcgctctgttgcccaggctggagtgcagtggcatgatcttggctcactgcaacctccacctcctgtgttcaagcgattctcctgcctcagccttccgagtagctgggattataggcacacgccatcacgcccagctaatttttttatttttcagtagaggcggggtttcgccttgttggccaggctggtctcgaactcctgacctcaagtgatctgcccaccttggcctcccaaagtgctgggattacagtgagccaccgcgcccagccaaaagtttttaatcttgatgaagtctggtttatctatttttttctttggttgcttgtgctttttgtgtcatatctaagaaaccattggaaggcacattctgtcactgagatttgccagttgtccttactgtagtattttacatgggtcatatatttaaggtccttctgagattcctaaaaataattaattcccttttctcttcaaaagcttttaagttaatagagggtctagaagtgttcctctctcttcatcacttgtccttatcctgacctgccttaaagcatgatcccttgattttatctgggacatctgagccacaaaagtctctatatatatccattggcaagaggatggtagatccttatgtatgtcgatggtcaggattccttcaatttcagctcaatagcagagtggctggttaaaaatgtggaaagatgggagagccactgccaaatctcctcccatttttagctaatgatggttctggaagggactggcctgctatttcttacaattccagaaagtatccatgaatgtacatgctgctgctgaccagccttagggagggcctgatttcttatgggcttaaagttatagtccatcaaatctaagttagggcagataaaagacagcttatcaaaataaaggtacaagaggtgccattttgaaacctaatgctgtagaaaggatgtaggcaagtaacagctgtcagtaagcttcccacccctgctgcgctttcggtgtgtttgaaaagagaacaactccaagttccattttagaatgttaaagatctaaaaaatgtttccaaattaatttttctctcaaaggtttgctgatgcgcaccagactgtaaataattgccctaactgatggccaggcccttattctcagaaggggatataggtgtctttgtgggatgggtatccttaagcaggatctgtgctcctaagaacagcagcaacaggcagtgcagggaccttctgttgaattctacctgtaaaccacagcctgtctggaaggtctgactccaggccactcagccttggcaagcatgtacttccgaaagcgcctggcagaaatgggagctgatagacaggcgcacatggcagggggagatccttgtgcagtggcttgacactaactagaccagagaccatttcccatgttctttttcataacaccagaagcaccaaggaaagagaagaaaaaaattttgcacttatttttgggtcttttctatcacatgaaattcatctgaaacagttcaaattttgtttgatgttttagcaccccatttttcctgttataagatattcagtctctctgcagatataatgcaattggcttttatatcatgattatgtttttaaaaataaaataaatggagttgactaccacacagaagttttacttgggatggaaattgactcttcactaaaggtcaaaatagaatccatttgttttggctgggcgcagtggctcatgtctgtaatcccagcactttgggaggccaaggtgggcggatcacgagggcaggagatagagaccatcctggttaacacgatgaaactccatctctacttaaaaaaatacaaaaaaattagccaggcgtggtggcgggcgcctgtagtcccagctactcaggaggcaggagaatggcttgaacccgggaggtggagcttgcagtgagccgagatcgcgccactgcactccagtctgggtgacagagcaagactccgactcaaaaaaaaaaaaaaagaatccatttgatgtgcacgcatctcttaagaagtgactgaaggctcgtgcctgtaatcccaacactttgggaagtcaaggcaggaggattgcttgagctcaagagttggagaccagcctcggcaacatagtgagaccctgtctctacaaaacattaaaaaattagccagatgtggtggtgcatgcctgtggtcccagctactcgggaggctggagcgggaggcttgagcctgggaggtggaggctacagtgggtggtgatcctgctactccaacctgggtgacagagcaagaccctgtctcaaaaaaaaagaagtgactgaattacataaagctggatctcttaccagccccctgcataccccaatccctctgtctttgcttaggttgggctttcttttatgaataatagaaaataagaaaattgcctgttttgggcaatccaggtgtgtttcagagatttggagttaaaaagtcaagtaaatattttggcaacccaacaaaggtaagaaaagaagcatgcacctaacgggcttctcgaattacaggcttgtccaaacactgccttcctcaagagacgctggtcagggacaaagcctgccctgctgtcaacagcaaggcccggctgagaagtgggcttgcttctcttgctggtcctggccctgagccagataggacgccatttgactttgattcagtctgacccaagagaaaatataccatcagcaagtggaggatctttcctccttaacagactttagtcatattgcttcttcttccttgctgaaaaaaagcccaggtagatttttctctcccgttaaattggaaccctgaagttaggaggcacagtatctcagatactgtcagataacaagagccaccttttcagtctctgtaacttcatctatctcgagggttgggaggcagacagctatgaaagaagacccaaaagcagcagaatctgggcatcccaagtgtacccgaagcacgccagtctaggtggcccctctgtcacctggtttaagaacagacatcttagaaggaaggagctctgaccagctagtggcatgtctcctttcaagctgtgctttgtgtctcttcaacagaaaggcagacatcagagaactgcctctcttcctcgccctcccccagtggcttcccctggatcaccttggcagggcctcatcctgaggagggtgggtggaggagggaggagggcgggtggcggctgcagtggcggctcctttgatcacctcccgcccggttccagtccctgctgccagcaggccagccaaaggcccgactctactgatctgatgaggtgctgaataggacccgaagggcagggacagagcaagaagaaagcttcgggaatgaaaaggaaaccccgtgaacctgctcggcttcattggccggattttcctaccagggagccgctcagttcctgccagccagggactgcctgcccctcactctggcccctcttgtctccgcttttcagacctttgtgtgtgttttgtgtttgaatcacggctgctctccctggttctcaggctgggaacccactgcgcctgtttccatggtcactgggaagctcttagcgccatgtgcttcaaagggaacctttcccctcccagcactcgctgctgcctgccccagccaggctcacaataagcggctcctccaagccaggcctctgaccctcacttgccaggaggaaaaccttgcctttgccaagcaaggctgtgcagcctcacagaaatattcctcagcagagcatgtggatgcacacacacttgtggcacatcagtcctcacgtgcctacttgtagatttttatgagatatagagcttatagattggtgagagagtgttaactttcctcacatccctctgtttaggaacctttctgaaattgaagaaaagagcaaagcctaagccccttgtaggaaaagagatgagcttgtttggggtaggaggaaaggaggaagaagacccatgtcttttgggtcagcagagaatggaattgaagaacttagctctgggcttcctctccctgcagctggggtggtgagggtggtacctgttcactcttccagggccaaggatgcctgagcagttgcccaccaggcttgaaatttggctttgcttatttgttgaataatgcaggggaatgaagcctctcacatctgactggagagagtcagtggtctagtgatcttggagggctgctacatgatgacactggaattaaaaggtgactgtcaggccaggcgaggtgggcggatcacctgaggtcgggagttcaagaccagcctgaccaacatggagaaaccccgtctctactaacaatacaaaattagctgggcgtggtggtgcatgcctataatctcagctatcgggaggctgaggcaggagaatcgcttgaaccctggaggcagaggttgcagtgagctgagattgcgccattgcactccagcctgggcaacaagagtgaaactctgtctcaaaaaaaaaaaaagactgtcctctgaagagcttatgttttagatgcaaagcctgctcccctagcttggagctcacaatattaatatctgccttgggcttattgcactatatagagcctgtatgggaaattggacatttctccagtattaccagtgatcaaggttcttatcatccgtttctttttttttttttttttttgagacagttttgttcttcttgtccaggctaccgtgcaatggcacaatctcggctcaccgcaacctccacctcccgggttaaagcgattctcctgcctcagcctcctgagtagctggacttacaggcgtgtaccgccacgcctggctacttttgtatttttagtagagatggggtttcaccatttggtcaggctggtctcgaactcctgacctcaggtgatctgcctgcctcgtcctccgaaagtgctgggattacaggtgtgagccaccgcacctggcccagttgggctcttttgactcctgatattgtctttccttatcgttcctggttccttatcagtctccaggctggctgctgttggagtgtgggtggccccctgcagaagacactctcagtagttgtgctccatggctttctgtgtagtgatgggaatttcagggccatttcagatgtgccctttgtattactagaataaagtgcacctatttggtattaactctaatttctacttgtaactcatgattctggaaaaggtttctaaaacttgcagacttgaagcttccatcattgtaccaaaatctgtcttctctggccacatgtagcattttaagggtaggttttgataaagtcttagcccaggagccgcagcatcccaaagatgcttttctgttagaacatgcatacacagacctaaaagttagtacatttggcatgcctgtgaaaagcaaactgaagaagaatgctggctaccataaaacaggtgtcatgattgcattcctactgtatgccaggtgttttcacacattatctgaaatccttacagtatccccggagagaattgttatcagatgatcattttgctgctaatgcagggaggaggggacagaacgacttgaataacgtgtgtggtcatgcagctggtctgggcagaggtgggtgggagcaaaggcccctggctctaatgaatggtcttcacaggggtacctaccagtggttttgggattactttgaacagattctagggggaaagtttggttaaatttaggtaactggtttctcatcatttgggtacttgggaacctaataagtggacaaaacgtcccactgaaattatcttgttcacgtcatgcacggtggctcatacctgtaatcccagcactttgggaagccaaggcaggggaatcgcttaaggccaggagttcaagaccagcctgggaaacatggcgagacccccatctctacaaatttttttttttttaaactagctgggcctggtggcacccacttatagtgcagctactcaggaggctgagacaagaggatcgtttgaggctgcagtgagctgagctgtgatcgcaccattgcactccagcctggggtgacaagacctcatctctagaaaacaaatctctcctatagcttttaatttgctcctgatcgttcccttttgtaatatttttatcatagctcccctttttcttttatcagtttgcccctttcatagaaattccatttcttccttttttttttttttttttttttgagacagagtttcactctgttgcccaggctggagtgcaatggtgcgatctcggctcaccacaacctccgcctcccaggttcaagcaattctcctgcctcagcctcccaagtagctaggattacaggcgtgcacaaccatgcctggctaattttgtatttttagtagagatggggtttctccatgttggtcaggctggtctcgaactcccaatctcaggtgatccacccacctcggcctcccaaagtgctgggattacaggcatgagccacggcgcccggctcagaaattctatttctttcctttttgcaaagttacctgaaattgtacctctctcatttgtatgctcaatgaggaaggaaataagagagggtggcacaattaatctgtgttcaaaaatgtcatcatcactgtgtctcgtttgataagcagattgtattcttactagtgagagtagaagatcctgaatagttcagagtctggccagggcaccacaaccacacatttcagagcactgggccatggctgtggattcccccgaggaacgagtttgctgatgaccctgtttgtgctctccctgagggtgatggtttcacttattccatgctctgagccaactctcctaagattcttttatctaacatggcctgcagaagttaatggtggcatgatttactttgactattttagatgccaggcgtgtgtcttgaagagaccagtgaagaggggcttgaagttctgattcactcgaacttttttgggttttatgtctttcctttctcgtcagcatcaaggccatctaacttcaaggctgaatgaatgagttctgttttccttaatagggagagggaggagatggcctaggactcattcacagctgtgtgtgtggaaagtgcattggtgatagatcttgacttatttagtgatttttcagaagattgttggtttttcactggtaagaccaacaactatccttgttaaccagctttaaccagaaggactaaggaagttggacatctcgtaccactcgcaattgattttctaatgcagttctcttgtttaaattctgtggctgtgataatctaggtagccaattactcttttttgttaactaagaagatttatactgctgttgtgctagggtttgtaatttaaggtgtggacatgtccaggatgttaaatttagcttgtgtctcaaaactagagctatccaaactcttttttgctctggttgccctggtcccttgatgttcagcaagcagctttgcagtgcccacagcactccggcctccctccttggtactgcagggccactgtgaagagggaatcaggacaggatccttcaggtcttggcttaggcatctttttttcctaaaagtctttctggaccaatagtctgtcagcagggacggcttcacagaagagatgaaactcaacttttaagactggctgggtttgggggagggaagagaccaagaaggaaattccagcagtggggctggcaggagcagaaataacatgtggcgtatcccagagccagtcaaaaagagcaacttgactgggcgtgatggttttagcaggcaggagaaggtccccttgataaggaaggcatttccagggagtgcatcaagaggcatgcagaataatctgtcataagagtagagtttaaaaaaataaattcaaaaaaagaggcatgcagaagagtagtgcgcggtggagggagggaacaggatgtgcttaggcctagaaatagattgccattctggtcatttccatgatattgctgtgtattactgttctgtggcaatttaagtaaaagagaggaataaaactttgtaatgtattagagaccttaaaacttaaaatccaagaagatttttatatacctgaattaaaaagtgggacttggtagaagttacccaggaaacataaaaaaatgaacagccttctcatttccccacttctgtggtcctaattctttgaccttgaatcttctctctctctttaaaatggtggtaactatatacatcatataagcttcaccattaagtgtacgagttcagtggcattaattaagcacattcactctgctgtgcacccatcatcactgaccatctccagaactttttcctctttttttttttttttttttgagacagtgtctcgctctgtttcccaggctggagtccagtggctcaatctcggctcactgcaagctccgcctcctgggttcatgccattctcctgcctcagcctcccgagtagctgggactacaggcatctgccaccacgcctggctaatttttttttgtatttttagtagagatggggtttcaccgtgtctgccaggatggtctcgatctcctgacctcgtgatccacccgcctcggccgcccaaagtgctgggattacagacatgagccaccgcacccagcccctcttcttaaactgaaactccatacctattaaacccaggctcctcacttctgcctccccacagcccctggcaaccaccattccactttctgtctctaggaatttgaccactccaggtcttttgtgagtggagtcgtgtatttgtccttttgtgactggcttctttcacgtggcataatgccttcaaggttcgctcttgttgtagcatgtatcagaattttattcctttttatgatggaattatatatatcccattgtatctacataccacgttttggttattcattcatctatctatggacacttaggttgtttccaccttttgattactgtaaataatgctaccatatatattctgtatattgatcccttacctgatatacatgaaatagtctttctcatcctgtggcttgccttttcatcctattgatagtatcctttgatacacaaaagttttttctcatttttgtttgtttgtttgagacagagtctcactctgcacccaggctggagtgcaatgctaccatctcaactcactgcaacctccgcctcccaggttcaagcagttcttgtgcttcaacctcccaagtagctgggattacaggtgtccaccaccatgcccaactaatttttctatttttagtagagatgggtttcatcctgttggccaggctgatctccaactgctgacctcaagtgatccacccgcctcagcctcccagagtgctgggattacaggcatgagccaccatgcctggccaaaagttttgactcttaatgaagcccactttatccattttttctttcgtcacctgtgctttcggtgtctcttctctttttttgtgcttgctctttaattcatcttcatctaccttttttttgttttaaacacatagaaggttacacaaacatatcttcctactcagccttggtttataatttactgttgccctaagaatttcagaaaggaaaagaattcttgcttccctggctaggctcttggggtcttgatgtgcaagaagaaatgctgttgtgaatacaaagaatgatgaggaagtatacaaaaggtgccctaggctggctgcgggggtccagcaggctggctacattattctgtggtcaacctcttacaaatggggtgctcctgtccgtctccgtggccagctgccaccagccctatggtgtgaatggcaaggaagtggggactggcggctggccgaactccaggatgcagccttggctggcagagaaccaaaggcagagggggaaaaacactcttgagtatgagagaaataatgctagctccgaaacctataattcgcaagtttaaaaaaatttaaaaaataaaaaagatttttcaaccaaactgtgcttttatctttaggttctgaatgggagattgttcacacagctaagctggctgcagaagctaggccagttaaaacaatatgcaggcagctctcctctaagtaaccagaaactgttggctcaaaggagcctgaaccgaggaaccaacctgctgggagacgttttccaagtaactccaagcaacagcctgaatgtaaatcctcccgctggggaatggcactttggcaaatgaagaccctaattagagatggaagggtttctattttgtttttctttaatccttaccctggggcctttgcagggccaccatgtctctgcttgtgtgcaaagaaatttccagcttctctttgtaacaagatcctcttttgggaaagaagcaacaagccgacaatgtgggcccaccacagccgggggaccctgcaaccagcctaatccaaaacaaaaaggcctggtctgggccggagcagctgggtcacctggattggccaagtcgtttgaagttgctagccaagttggatcttatgttgcccctgccccgtgagacactcaaatccgtgcttagagtgcaagtgaagtttcttaacttccaaaggagaacagcagtgtgaacaaaatgcaaagcagtaagagagaactgtagctctgaggcactagggccaaggtccaattgaatgggtgtggagccctcttatctcctcagccttctatttgggtcttcactattggatctaaacagtgaagcagagggactatgctctctttcaaattgatcaccttagttctcaaaacatccagaagtatcacatacgtggagaacctgcccacgccagtgttgttttgttgtgggtgcaccattgacttacccagtattctcaaggtcttcgaactgatgattctgctcaatttcatttctctttggccctggaaaggcagttgagtagagctctctgggaccaaagtatcaagctggtcagtgaatgatacaatcaattttagatagttgtggataactgaagtgaaaacaaagacatacctttcagcatcctttacactggtaggtgtaggaagggcccccatcgagggccgttaacttacttgttaaattcgcagcttactacaggatgcttgtgtctaagtgatttcaacttctgaaggggaattacacattttttagtcttaacataggaaggatgcttctccctaaccacgactccatgctgagtctcaggctgggctctgtccagatagaatcatctttaatatttacaactctgtgatctggttggtaccctgctttaaagatgaatacattgagactcaggggaaggggctaagctacagacatcagccatggctccgtcccaggttagctccagacctcctgctcttctcatcagttctgtcctttgagttacttaagcgtatagatggtagttgatacagttctgcataacagactgataggttcctgaccaacagtctgctcctaccccctcttttttgggaagccgagtgctgttgaagagccacccattcctggttgccacatggtagacaaatatgtctgctgcatttacttcccagaagtcctcagcttgctcatgctgtctaaagttagctttcagggaatcccaagatgtttctttttcagctctctgcttgtggtcaggctgcttcaacttggagaaaaacggcccattctgttagctgtcgggcaaaatgatgactgtgaagagtatcccttccatgctagtaacttcccctgttccaacttctcagtttaattttcagtgaagcttctagaaaccacttaaagtcattgggaaacaggtacatcaaggactaaaaagaaaactggttttgtagatgcaacattgatccctctaaaaagataaggcaagacgacaccttgcccttttgtctttgattttattccttggctccttggaacatgtgctgattaaatggcaaaatatgatggcaatttttaccctttgttattattgaaaatctttgccaagttacagttacagctaatttaaagctgtatccaaccaaaatggtgttaagagagggtccctgataatttggatgtcaacttgcacttgtacctaatgaacagcttgactcattcctggctaaatttatgacagtggctttggaaggggactcagatatcaagaaccagattctatcacagatttttagattacttgtataggccataaaagcgtgatgatatggagtaaattgaataatactggatttttggcattgctgcttcattagcatgaggcactggatggggcaggcgtggaggcctggttaggctgggcgcaatgctctaacataagcaaccatgggcctcacagaatattggtggtagcctttcccaggatggtcttgcattgctaataatgctaaaaatgtctgtgttcagagaaaaacattatgaaagtcttaatagtctcaatattatcccctaaatagcttttccctggatttttttcatctgtcctggtcgtttctgtgtcattgctgtaaagtcacacagccaaagtcacacagccattccgagtattgcagtgacaacagcaaggatcccagccaaaatcttgtcctcaggaagagctgagacatgttactctaattatcactgatggttttattgctttggggtcatgtctcaccccttaccccctcacttagtggcatatttgatgttgttcagtcatctgaagtcactcatttatcccctgaatgtccccactggttcccccagtggcagcagtcccccggcctgcaggagttgtagtgcaggcttgggtgatgtgattcctgatgtaggtgagacccctgaaccaagagcagttcagcagctgcagctgctcagaagctaggcttacacaccatctccctgccgctccgtgtttgacagaaagcagagatgcttcagcctcctagctgcacttaaaggtagcctggatgcagtgagcttgactaagtatctcccttttgtagctcagtgtaaaatacagactctgtttttggaattcattcatatgtttattaagcactgcctgtatcccaggcagtgtgctagacgctgcagatacagtacttattaaagtagacaagttcactgcccccatggggctcctggtcagtagaggagacacagagacaactagcagcaagtaaacacaaagacaacaaacagggcaactgcagattgtgatgcagctgcaaggccaacaaactgggtgagtggggcttttctctgcataggctgcctcgagccaagagctcagagtcaaggttcctgaaagaagagagggaaagattcccacagcccactccccacatcagagcttgcctgcctccgctccgtcatctgttctttgacacatctgcaacctggggtgtgctctgatgcttcctgtcattctgtcactttctaacccatcaaacagcactttgctaccatataagtattagtatctgcctcctgtctgctaagaaataaaatgaaggcactcaagtcttacagaaagttagctcctttattttaggtatctcgttaaatattctctacttgattattatgtgacagttgcttttaaatcctctgaaagttgcataatatgctatgtgatacgaaaggatgtatatataaaacctttatttttctaataattgcctataacttaccagtttgaattgttttaacgcttattgtagcctaagaagtccaaagtttaattgaaatccagttttgttttttggctttgggttaatattcttccttccaggctgggcacggtggctcatgcctataatcccaacactttgggaggccaaggtgggcagatcacctgaggtcaggagttcaagaccagcctggccaacatggcgaaaccctgtctctactaaaaatacaaaaattacccaggcatggtggtgcacgcctgtagtcccagctactcaggaggctgaggtgggaggatcacttgaacctgggaggcagaggttccagtgagctgagactgcaccactgcactcccgcctgggtgacagagtgagattctgtttaaaaaaaaaaaaaaaaaaatccttccagacttctttccctctcccgtggttttaggaagggaaggacagctgggcatgatggcttaaccctgtaatcccagcagtttgggaggccgaggcgggtggatcacctgaggtctggagttcgagagcagcctgaccaacatggtgaaaccccgtctctactaaaatataaaattagctgggcgtggtggcacatgcctgtaatcccagctactcaggaggctgaggaaggagaatcgcttgaacccaggaggctgaggttgcggtgagccaagatcacgccattgcactccagcctgggcaacaagagtgaaactgtctcaaaaaaaaaaaaaaacaaaaaaactgaaactggcttggctgatgaaagttgtatcttatactgtgaactgaataatgttgcaagagattaagtgatcattactaaatgatgcccctggtactagtgaaggttgttgtcatagttcatgcagacctgcacagtgtatcgacctcatgttcacatgaagatctagatacctgatcaacgaagtgtccactcagcccctgtcaggtgcattctgggaggtgaagtggtatgtgactgccttgaaggaaggtgaaagcctagagacagattgtaatggtttagaactttctctttagaaaatagtgaataaggaaacaaggctttgctggggcagggggtgggagctctggcaaataagaggttcttctagaacccacttcctttgttctactaagtaaagtcttgctaacgctgaataattatagtcaagaaagcctgaatgaggccatccttttacttgttcaataaaggttaatttaaggacccaatgggacttgagatagagcttgaatttagggatttttgcaaattacctgttaaagccatgaaaacagaagtgtatttgttccttaatatgtgcatgacctcttactatttaagagtgattactgattaaccagggagtttcaaaggagatgttttcatattcagatttaaagaagttgctccagctcagagaactggcttctgttggagtgagctatgaacagagtagggctgctctatctcagagcattgttcattcacctggagaaacttccttcctgtgtcaagcacctgtagcatgctaggggttgtgcctgcccagtggtgcactaaagccacctctgcaatgttttcatccaagaaacatgaagtaggaaggaaaagtaacacttgcctagaaaggaaagttgtctgctccctatattctctatgaaattgagacagctattctttgcccccacaaatggcctttaggacagaaccattgagtgtcaaagacaggcccagcctctggagtatacttgtctatttccatttccaaaggtgagatgttttccaggcagagctctgtcagttttatgaaagccaaaaatgcattagccacacagggtacacttgtgcagtattttaagtgtaacttggttgccaacacttgaattggaaggtttaatataaaaatccacatttctaccttctcttgaaaaatcagaaggtctggcagtgctggtgtcccatttctcctggtaaaggaagccccagctgcctagaagttgcccccatcaggcaggtgtacactgtccagtctgccacggcgcctgccactctctgctgtcctcacactgcagcagcacatccattgccgtaaatcttaagtgtggcccctgtggacaattgagtttgcaatctgtgttgtgtgatttttaaattgcagggaggaagatcatccaggctgtctgtggaaagttgagcaaatcaagtgtgaacgcagaccaataatttctgacagtcaaaccataaatatgaagagggaccacagagaagctggattagcagacttgtatactctgattttgtcaagcactggaagaccaatttagggtgaccatatcatttgtcatccaagctgagacgcttttgagaatggaaggggttatggtgggaggagaaatgtaaactggggctgtcctgggcatgctaggacagaaactgtggacaccctaggcctgtgaatgggacatggaaacagaaagcttatatccgtcaaccaggatgagtgcagaaaagactcataagaggagctcacatagaggctacgctggtatagaaattgttctagaaaaattgggcaagattttgcagagaaaggaggcttttagatgtgtccttaagcattgaagcgctttgagaggtaatcaagggtccaggacagcagttgaggtaacatgaataacctatgcaacagctggaagatgtgcgtatgccttaacttttcagaaatgggggaactgtgtgggtggagcatctggtgcttggagggcagatagtgtgggaggggagggcggacgggcagaccggatccaaactggatccaaaggagagtcttgaacattataaggaattgagacttgaatctgagaaggatgagaagacagctcagggcatcatgtatggaatgaactggaaaaagattggagacagagaaactgctgcattacagggtagcagggatgcaaagggagagcccacttgaaaatgattctttatggagattggatgtggagagaggaaggggaaggggtagtgagagaagaggaggaagatttgggtttctagatttgtatgatggtgattcccttaacctgagacaagtaatgtaggtttgggagaaacttggtgactttgactttgatcaggactagagccctgactctgactttgaactggagccctttgaactctagccctgaaaagggtcagggctagagatgaaggttgagaagtcattagataggggagtgtgtattcaaaccaggagtccagaatgagcttgtccagaaaagagtatagactaggaagagagaaggggtacagcataggacttaaaggaaaacaagtaagtgagttgggaccatgtaagagtcagtgaagggaacccgaagacctcagagagaagaaaacagaaataggctgaggagcacaaagcaatgtaaacaggttggtagagtagcaatagtacagatgacaacacgggtgaggtagcatggccctgtgcattcatttagcacaggtgtatcagttagcttttgctgcataacaaactgcccttaaaacatagcaccctaaaaacaacagtcattttcattgctcatgattctgtgggttagctgagcagttgttctggtctgtgccagcttggctgatctctgtggtcagctagtggttcctctgggactgagtgatctaggatggcctcactcaagtgtttggggcctcacctgggatagccatgccctctcaacatgtggtctcttatcatccagtagactagcccaggcttcttacatgatagttctcagggttcccagccgcaagagagggcaagcatgaacacccatgaactattcgatcccctcaagcattttccaagcttctgctggcattgtatttgctcatgtcccattgaccaaagcaactcatgtggccaagcccaaattcaaggggtggaaaaataagctcaatttcttgatgggaggaatcataaaatattgtggccattttctttactctaagaggtgtgaatgtcttgtaacacttggcaggagatatttgattctttgtgtcaatcatgtatcttccttctagttgagctagtaaagattgaagattacaacagaacaacttaaattctgaagacccatttaattgtgattattttaattctgttcccatatgaaagctgaaggtagtacagggaaaaacagtaccacttgcattcatgacatgaagctaaagcgattactaaagaaattgataatacccagttcaaaactcaaacacaggtcccctctgtcaaagcagtactgtctgatttgcagcaattaacatcttagtgccatgttatttaagactagatcaatgattagcaatcattaattggcacctaccatgtacccaaactacaccaagcactttacacccatgaactatttaatcctctcaacaaccctataaagtacaatcactgtcttagttctacagatgaggaaactagggatcaaatattaagtgtcttgcccgaggatatcagtaagtgtgatagaaccagaaataggaaatagggatttccctcaggccactgggctcccctgactgtaggcagcattagcaagtatgcaccccaccccacccccatcttgattatccttatcttgatgaaatatagttgtcccctcacatttgtgggaaattggttgcaagacctcccccccaatccccccatggataccaaaagccacagatgctcaagtaccttatataaaatggcggtagtatttgcatataacctatgcacatcctcccgtatactttaaatcatctctgattactttatgatacctaatacaatgtaagtactatgtattaataaatagttgttataatgcatggttcagggaataaatgacaaggaaaaaaagtcatgttcagtacagacacaaccatccttttttttttttttttttttttttcccccaagacagagttttgctttgtcacccaggctggagtgcagtggcataatctcggctcactgcaacttctgcctcctgggttcaagcaattcttgtgcctcagcctcctgagtagctgggactacaggtgcatgccaccatgcccagctgattttttgtattttagtacagacgggctttcaccatgctgcccaggctggtcttaaactcctagactcaggcaatccatccgcctcggactcccaaagtggtaggattacaggtgtgagccaccgtgcctggccgcaaccatcctttttcttttccgagtatttttcatccgtggttggttgaatgcacggatgtgaaacccactgataaggagggccgactgtatactcacatctactgacctggggtctgcctgcctcccagagtccaggtgggctctgttctgctggtctaacttacccattcatccagatttcattgagaggggctttgtttttgtgtgtgtgtgggtgtgtgtgtgtgtgtgtgtgtgtgtgtgtgtgtgtttgagacagagtctcgctctgttgcccaggctggagtgcagtggggcgatcttggctcactgcaagctccacttcctgggtttacgccattctcctgcctcagcctcctgagtagctaggattacaggcacccaccaccacgcctggctgattttttgtatttttagtagagatggggtttcaccgtgttagccaggatggtctctatctcttgagcttgtgatccgcccacctcggccttccaaagtgctgggattacaggcgtgagccactgcactcggcctgttttaaaaatactgtaatcccggctactcagaaggctgagggaggagaatcacttgaacccaggaggcggaggttgcaatgagccaaggttgtgccatcgcactccagctggggaaacgagcgaaactctgtctcaaaaaaaataaataaataaataaataaaaataaaataaaatactgagccagttttagtagatagcagaaggaggtattatgttgctcgatctgcataatttttaaaactggctttggaattttcctatattaactaaaattaaatgcattcacatggtgaaaggttgtctgtgtcaaaatagttttgctttgaagtaataagaggcaataatggaaaaagaatagttgcagattctcccctcactccttgttttaatcttttttttttttttggagacagagtctcgttctgtcccccaggctggagtgcagtggcgagatctcggctcactgcaacctccgcctcccaggttctagagattcttctacctcagcctcccaagtagctgggattacaggcacgcgccaccatgcccggctaatttttgtatatttagtagaggcggggtttcaccatgttggctaggctggtctcgaactcctgacctcaaatgacccacccacctcgacctcccaaagtgctgggattacaggcgtaagccaccgtgcccggccttgttttaatctttattgaagtataatagacatgtgataaacagcacatatttaaagtgcacaatttgttaaggtttgacctatatgcacacacacatacacacacacacatgcacacacacacacccattaaaccatcaccacaatcaagatgaacatatatgtcactccccccacattccctcaattcccctttaaaatccctccctccctttcctggcttccctgccaaacaccagacaactactgatctgctttctcctactgtagacaagtttgcattttatagaatttaacacgaatggaatcatgcagtatatactgcttattctggcctctttgacgcagcataattattttgagatacattcatgtggattgtgtataacagtagttcatttctttttattactttttaagaaaagagaacgctgctttttttactctgaacttgggccaggatgattgaagttacctacgaattgtacattaaccaactaatggcagtgaagagttaatctgtaacttcatctgttagctgttaacgtgacccccaaacctaacctcctcttgactgtcagatcctgatcccagacacactttctctaaaggctaaaactgaagtaggactggagacttggggagcctggtatttctgagtcttggttggtccctgcccatcactggatcttggtgtagcatggtctcatgatagtgtgagaacagggttaggtatgtgactgtgtgaccagcagtactctgttaaaaaccttgactttaaattacttcatgaagtttcagatgggggaaaaagaacccacaaccctgacttttgtcagctgtccgtcttacaagtctgagttacgcagatgtcctaatccttttagaagcaatctcagtaggttggagaatttattgttgttacagatactcactttaaaatgtattaagtgaactcaattggtatatttgaaaatactttaatttacccttcttttcaagattccatctcccttataagctaccatacacttgcctgctagcaggtcctttatagtcaacttccctgtaacaaatgagagttttttgggtataaatgtatggggtacaagtataatttggttacatgggtatattgcatagtggaaaagtcagggcttttagtgtagccattacctgaattatgtatattgtacccattaagtaatttctcatcgtccacccccctcccacctccaacaaattggtttttaaaaaattctttccttaaatgcttggcttcaaatttcctggtacaggaattctgtaattctgataaaaaattgcttgaaataatacacaaaatgtctatgtgtttactaatagatcctgattaaagttattattgagaaactaacattggagtcctctaaattctgatttcccagaaaacaaaaaatcttcaatattataaaacttaatggactctacagaagtcggggcagggttgacaggaagcagttggctctgatggaacaccctcccccgctgccagcacactctgacctcaggaaagtcatgcctcctttgcaaatcttggacatgggactaggtgtgctttcatcccactccaggactgagggacacttgattcagatagaccatagtcaaggtccatgttgcctaagagaccctctttgtcccccagcatgaggactgcagtgactttcaagtggctcccaggagtggagaagcaggctgcttcccttgcatgggatccattaactcccaggcatggagaagcaggctcagttccctacggtgggctatattagctcccacaaatggagaagcaggctcagtctctccttgggtgtgctgcattgtctcccaggaatagagaagtaggatcagtcatttattccatgtggggctgtctggccagaactcttccctccaaagggagtggtttgtggtccctcttctggatttggctcatcagtctttccaaatgtcccagccacctggtaggtatgcagtttgatttgtttagcccccaaatgccagccagttccccatgcctgcctgatagctgggtgcctcttgagccaatgtcggcatattctacaattacctgcttatttgtgggggttacatagtgcttgtagttatagctctctccacttacccacaaaccagactgccaaactcctggatcataaaacaaagtgtaagcaccctggatcatgacccagctcttttcctgttcttcttttgagactttcctaacaggaaaggctctgggtaattgatagagattatccctgattcccttaatgtaacctttttactctttccttttcctgggattaagctgttcttttgcaagaagtccttttcttaatgacagtcattcacctgttattgaccaaaggaagcgatccggcccaactccacctttctgtggttcagtctctcgagtctctttcattataatgactttcaaaggcattaactgtttttttttttttgctttcaattttctgcactgttaaaggctgtcaaactatactttaatctgccttcctgaaacaataattgcccctgtatttgttggtgaatatgagtgttaatattgagtagatgttttaatatttgctgagggttcccaggcagcgtgcgttgctactgaggtctgctgttcacaagataacaagttgatataaagtggagacacataggctcagtcagcagtgcctttcttcttcttgcagtcctgtgatatttctcttcttcagggcacttacctctcactgtgcatgtagggtccctagtataactactagaacaccatgagaagaggcactagatcttttaggactaggttcttttggcatatgattgtaccttcatggtatatgctcaataagtatttgttaaattaatgaatattttgtctggaagcacattgccacaggactgggccttggtgtagggattagggaaccccttccagaaaaaataaaatttcaggtagtgacccaaaaatgtcagtaaaccatagtgactgcttggatgctgtgttccagaaactaaactgtgggcatgccagctgccaccaacagaaagggtaatcactaaatagttgttaagtttatacaatggccatgtgagtggataataatacccaaccatgcaaccctgtgctacttttttttttttttttttttttgaagacagaatctcgctctgtcgcccaggctggagtgcagtggtgccatcttcgctcactacaacctccacatcccaggttcaagcaattctcctgcctcagcctcctgaatagctgggattacaggtgcccaccaccacacctggctaatttttgtatttttagtagagacggggtttcaccatgttggccaggctgatctcgaactcctgacctcaagtgatccacccgcctcggcctcccaaagtgctgggattacagatgtgagccaccatacccagcctctatgccaccttttgctaacctctcccctatacttggtgtgtctgctgcctccaccagcacctttgatatccagctgctggctggccttctcttcctcttcattctggcagcttggcctccatgaagtctttcctgaccacaccagcctatggcacacatcacccccatccaggatgctccattgcagaagtgtattgagcatccttcaaaataatcccacccaattaaactcttaatccatttgtttcccttgttggtctagttccatttctctttctttcttttttttttttgagacggagtcttgctctgtcacccagcctggaatacaagcgcatgatctaggctcacggcagcctcctgagtacctgggattacaggtgcaggccaacatgcccggctaattttttgtatttttagtagagacggggtttcaccatattggccaggctggtctcaaactccggaccgcaggtgatctgcctgcctcagcctcccaaagtgctgggattataggcatgagccaccgcgtccagcctctagttccatttctttaacctagtggattgcaagcccctcactgctttccagcccgaaaggggcattgatgggattgtgaacacaggacagaaagtagtattaatgattattgttacaccccggatgcgtggtagggatgcttgggagcacctttattctccagctagcattagctgtcgggctgaggaaggctagcttgatgactctgccacttttctccttccccctccatcatcagcaccattgtgatgactatttattgagtaccaggactggaacgcatttgggagaaataaaagcatagatttgacacagccttcattctgttagcctatggaaaggtgattatagcacttgttacttgaattagacccgaaaatatagcacattttagggtctaattcaatataggacactctgcgtttaacttatgttttacagcctaactcatgactgctatggccaatatcccttctccacacccccagaccccatcactaaaattccttctagtggcagaaccgtcaccacttatcacagataagtggatattagttgggcagttgacatacaagttctgtgacttggttagctcagttcagagtatgtttgagggcttacttcaagaaagcatgtgtttcattttttaaaaataggtcttaaacctgaaaatggtgtccttgagattctcatcgttctctatttttatcctgttatcgcagaagacccatctggaacttgcattccattgctgtctcctactcaaggcagaggctcctatgcaagaccctgggactcctgtggcatggaggccaaaggcctggacccaaaagtcaggaggacttctgccacaaaccccaaaagcttgccccgtataaatggttgctcttgtgcccatggctgtgtccacccagcatttttgtgcctgctgggttccaggtgccatgccaagacctggtgaccagaggatgtctgtgatcattgttgtttggaggcttttgattgtgagggacccagacttctgctttgggggtatctttccccagacatcacaaaaagctcaattgtttattgcctcgaagacacattttctcttcaacaagcgctttccttaagtctgaggtagagtagcataagtgggtttcttgaaaaccagaaatgtagctgagaaagcagttgggccattctaggagggaaagaacaagggcttgatgagttaggttaagaagcacattcccagctcaccatctctccctctcttacctccttagcatcttggtctgtggttacgcatcttggctgcacctaagagttggcctgaggagctttcaaacctacaaaggctagatctacctccagcccggttcccattagtcaatctccaggaaggagtctacccctctattttttatttaattttatttatttatttatttatttttgagatgaagtctcactcttgtcccccaggctggagtgcaatggcgcgatcttggctcactgcaacctccgcctcccgggttcaagtgattctcctgcctcagcctcccgagtagttgggattacaggtgcctgccaccatgcccagctaatttttgtatttgtagtagagacggggtttcaccatgttggccaggctggtctcgaactcctgacctcaggttatctgcccgcctcggcctcttgaagtgctgggattacaggcgtgagccaccatgcctggccccctctattatttaataagctcccccaggcattccgacataccactgggctgacagccactgaccaccctctgccagactcatgctgtgtcatcatttcttggcctaaactgggacgtccctgcatgtatatgaagtgtaacatggtcatgtcaacttccagaagccttcaggagatagattcagtgtcatccccattgtgcagatgaaataaaacagaaaattcatcacatgctcacagtcacagagctgggaaggtgagctaggatttcagtccaagcagtgtgagatacccccttttcttcctgctcttccactatagcagtgctaaaaagagcctgggttggccagcctggctttggtagggtgtcatcaaactgactgcacccagataagaataacatggctgaggggggccatgtaactgcccttctctagagaaagggatttgattctgtagctgttataaatgattttggtttaaggtgaagagataatgaaattttcttaaactctactaatacaaaatcacgtaaaaggagtcaatatcatagggtacacaggggaccattttgaaacaacttagatccttaagaataaaggatgaaagttgtagtgtttgtgaacttgcattggctacaatggcaatgaatataacgcctttggatgaaatagtctttgactaaataggcctgagtttttaagcaggtaaccctgtacaaaagtaggaaaatgttccaccctgccacctctcagggagggccagatgtgatgcaatgagtgtgataggcagcaaggggagaaaaaaaatccctccttatgttgactacatgagctgcacgacatttgtaaagggaaatttcaagagaagggagaccaagtgggttaggataagagctatctggaatttccttgtgttaccaggaaatataatacttacataagctattaatggaatatttggaggttcagcattcacattgatatatgtgtacgtatctccattacacttgattttagaaccccctgggacaacatgagtatttctctggcctgggattatggagagaggcttaggtcaaatgtcagctctccactttgtggctgagtatccatgggcaagttacgtaacctttgagcctccagctgtaaaatggggatcaacaccacctcccttgcagagttgctctgcagattcagtatcatttgaaagcactcggtgccttgcctggaacattaataggtactttccttactttccctcttggagtctcagtaccactctatgaccaagcaggggggccgtgctttaaggcccctcttttaaaccttctggccacagggtgaggagtccaaggggaagcccctgtccaaaccattcccagcatccctaaactcccctaagatgaccttgtgttggtttctagcccttacagacctctcttctaggaccatcctcctggaggcacagtgcactggcagcatgcccctcttcccaaggatgtagacacagcttggcctcaaagcctagggtgttcacctgcctgtgtacaaccccctcaaagtgcagggtggaccaggggtcagctgtctccacactgacatgctctggcaaggagctccaaggagttggaaagctcacctggaacctatgtttcaagttcttatgaaggtacatatgtcaagatagaagagtaagatctattttatttactagtttgttagcccttgtcccctgtcccacgaatgttagaagcaagcaaaaatgctttcatccaaattaccttcctcttcataaaaataagaaaatcatgtaatcaaaataatcttctgccttctcaatgagtttaccacctgattcagcaattttctaacaccttcatttgcctcattgtaagtagtcccagtgcatgctggttagatggcctctgggtctacatcagtccaactgaatcaggagaggagctccagaaggtgcactggacagtcatgccagaggccgtgtgcaattttaggttagatcagtggttctctgccctatctgaattttaaaataactgcgaaacttctaaaaaatatattgctgctggggttttatctatatagatcaaatcatctctaggggtaggtcctgggctcgagtttttttgtttttgtttttgtgttttttaatctccccagttgcctcctccgtgagcgaaggttgagaagcatagctgcccctgtgaggaactcagccttcagagagagcctgcccgccgcctctcatcctccagagaggctgtagggtgtccagactttgcaggcactgttgttcctcgttaagcctgatgctgccacctaattaacacttgtttatattaattagttgccatatgcattgaaggggagtggtcctttttgaagtttctagttgctgactatataagatttggcctgaagtgggacttctggaaactcaaccaagataacgacttccaggttcttccaaaagcttatcttccaggcataggcaggtaatgaaacaacccaactgcggttttttccataacatctttcaccccacagtatcgatggagcaggagggtgtggacaggctttcctgggtttttggtgctccttgtcaggtgttaaaacaaagaggatcattgtgtttcttggaactggcctaaacgtctatgtttaagattaagatctagggaaatgcatttccgtttgacacccactagtttctgattgtgaaaagggtaccaacctgtgcaatggcgccgcgacccggccgcggactccagcctctaaagtcgggtacctttaattaggagaaattaagtggggctgctacatattttgagaataagtaacactatttaaacttaggcagccttaaccactaacttaaccgctgaattctcgctgctacatgtctcctaaatagatcagcataatcttaactaggacttaaaatgcatcatcttcgttccggaactcagaacctgcagccgacgggagcctttggaggcttaatgactttaattatggcgagaaatatcttctcccggtggggaggggcgcggccggtggcgaggagggcactttcccgggtcggagaaggccggatggcagcccgccccgaaagtcccggcccgctggattgggggttcgggggtggggggaacatagagaagcagggctggtggaggggaggagggaccctgcagggcggtacacgacgggtgggagtggggaggaggagggctcctggcgcggggaggagccgcgggaggggggatgttggccgcagggcctcggagttctgagctgtgtttgtggcttcagcgctttgatctcctgccagggaaacctggaaggtcaggccgggctgcagccaagccctggagcgaggagccggcgggtggagctggcagcactgcgccacccaccctcacctcccaaccccccaagcagtgaagcccgcctggccgccctggcctctcgcccccgctcctgccgctgcccctgcccctgcccctctttacctcctgtgtgttggtctcctgtaggccgtagattaaggggctccaagtcttgaaagtaagctagccaaatgccctgcaagtttggcttagtaaaatcatgtatgttgtatatactttaaaagaaaccagatatttttttaaagctgtgtgcgtccctttcctccaccctcctcatccccaccctagtacaaattacccaagaaccacaggtgattccccctgctggttcgtgagtgttagggtctagtttgcctctcctcttctaccaccaccaccacccccgttcctggcaccaggattttctcaccggttacccgtgtgctcttggtgtgtgacctcatttcctatggaatgaaaagtttctgtcggaaaacagggcccttggtgaggcaggccttgggagcccccttgcccagcgagaatgtcctgtgtcatgcagtgactcatgcttcagagaacagcagctgaccagaatgttcaagagcctggtgcctgggtggtcactactaagtgaagaactcgaggaggaggaaaggaaaaagtgaggagtaaggatttaaaatccacttagtggcctccagagggagggggataacaggactcaaagagcctgggctctctggcctggggtaggacccgccaagagggacctgtgggcgtcaggcgtggccagtccctaggaccggctgggtgctctccatcgtgttaaccgcccttttcccctccctgaccacaggagcaggcctggtggcggcaacagaaacagggctggttcctgccgccctgcatttcagcagtgacgtgttccaggctccggctttagatggctgtgtctctcaagccttcaagcctatgcttaagtctcttgttaccccaaattagggcaccattgagttggggattttgaagctgtggtagaatttgccaccagttcacccagagagccaaggcgccagagcttcgcaccaggtggggaaagcagccaaacctgcactttcctggggttgggccgctgtatggtgtggccatatttctccgcaggttgcaggatgaactccatcagtcttttaggctggaggaaaggcaaggccccctagtgataatgggaggaggctgtaaaaattcacatacagcctgttcttgtggacatggccaagggtagtcatctggccagctttcttttggtaaaggtactaagggaggctcccattcctgcagaatggatggaacaaacactgcaagtggttgggcttgttttcagagagctttgatatccagagatgagcacacgcaggggctggggcctgatacagatccacaacaaggccaagccacttttagtgcctggggtcaaggttggccggaggagacacgatgtctgcattcgaactgacaaccagtaaaaaggctgtcaggaaatgcaacagcagaagatggcaccagtaataagaaaccgaatcctgagaatcttaaagtgcgaagaatattatgttccaagaaaatttggtagagaacagacctttctaaaaagtcaaagggaggagataggtggcctagagtgagctgcaatcagtgctttcagtagcagggcccatggtgtttgatgctaacccctagggcaaaagctgatcttttaggttaatcaacaaacattttttggccatttaccctgtgccaggccttttgccgggttctgggaattcagcaggaaagaagtctgacacactggctgccctttagtgaaggaggcattttaagtaaacaatgacagtgtgatgtcataagtgccacagtggtggagcacagcataaggccactgggcaccgcagcctgagggaataatacctgaacagagagagaagcagtaaatgaaccctgtggcagggggtgggtaatgtgctcctcattgttggtctcctgttaccccacatgtggccaccattgagtttgggattttgaagagaactaaaagaagctcagtctaggccgggtgtggtggctcaggcctgtaatcccagcactttgggaggccaaggagggtggatcacctgaggccaggagttcaagaccagcctggccaacatggcgaaaccctgtctctactaaaagtagaaaaaattagccgggcatgatggtgcacacctgtaatcccaactactcgggaggctaaggcaggataatcgcttgaacccaggaggtggaggctgcagtgagctaagattgtgccactgcactccagcatgggcgacagagtgagactccatctcaaaaaaaaaaaaaaaaaaaaaaggctcaatatagttcaacttaggagtttgagtgttgtgttcagaaacaataagcaggaggaggtcacatcttaccctaagagcagcacagtcattggagaagggtggtgcaggtcagatccatgattgagaacggtccctctgctactgcatggagaccgtgttggggagggggcaggggcgtgcaaggtgggctgggctgaggagcccccagaagagaatgttgttgggacttgtgagaaatctggtgtcctggccagggtggcagcagtggggatgaaaaaacgatggatggatttggaagtcagaatcagcaaaatttggtaagccattgggcataggtgaaaaggcaaagggctgcagttttgactttgccccatgggtggaggaatgggggagatggggtacctccttgaggagggagcccaggtttgggggaagtaaggattgtatgaagagcaggcccatggcaagaccccttgcacctacatccacccgagcaagaaatgacccagaaatgtccgggacagtgtgctgtgctctgcgaatagctgcagaagtaacttggggacccaaaataaagcagaatgctaatgtcaagtcctgagaaccaagccctgggactctggtgccattttggattctccatgagcatggtttctgcccccttcggtcacactacttatatgtaagtctgtcagagaagaggcccaagtgaacactcacttggataagaaggggagagacctcagtgtcttcatgctgctgcttgctaagcaaggtctcttcacccaggacagcagcaagtgtgttatgacagacaattccagaaggtcctggattgtgtcttccttgggatgcctggcacccagttggccctcttcagtagttgtcagatggaactgtatactcgaatgtttccatactgataaccatctcatttaaattatgggtgccatttagtaattggtttccagatcaaaatgtaggtcttctgtcatatccttcagccttccacctgtgagttaaagtgatggggagtgggttaaggggatgatactcctctcaccttgacataccatgagccatggagcagagtcctcaagcgtgctccatggaagggagagtgttaacaggagttgctgcaaacaggctttgtgttcaaaaaagtttgggatgctgggtaaaataggagcctctagcatgttagtgatgtatatgtcagggatagctctggaatgtgcagcatttctcaaaggacaccgaccaggaaaatcattcccttagtagatgcactttgggaaaggctactatagagatatgaggcaagtgaagccatgttcttaatttcttacccatttgcccttggaactaaatgtacatgctcttccttattgactctcctggactcttcagagagggatctgccagcaccatgggcaggatgtgtgcttggtgaggacaggggtctgtgaccacgcttgctgccggctgctgtatgagtccccagggtctagaacacatagtaaccagttaataactaccgtggaacaactaaattaatacatggttaatgcaaatagaatttgactgtgaaccatgcccagggcagtctgctttgttagaccttttttttttttttttttttttaatagacacacggagtcttgctatattggccaggctggtctcaaactcctggcctcaagtgatccgcccacctcagcctcccaaagtgctgggattacaggcatgagccaacgcgctcagccatgttaggctttatggggcataccaatgtggtcggtaaggtctacctcctggctcctgggagtttctgttaatctccaagggtatgcctggcacccaagcgaggcctttatgtataggacatctataccctttgactcagcagaaccactcatggctattaaggacagatgcctccagaatatgagtacaaggatatgaatacagcactgtttataacagagaaaatatagaaatctgctacgtgcctcttagggagatggtcattaaaggagctctgaataaccatacaatggaatgatatgtgtagctggtaagaagaatgaatatttttccacatcaatgcatataaatattgttgagtaaattgttgagttaagggggaagtagagtacagaacagtgtatgtccaatatgtccagtctatttattttaaaattttttttctttttgagacggagtctcgctctgtcgcccaggctggagtgcagtggcgtgatcttggctcactgcaagctccgcctcctgggttcaagcaattctcctgcctcagcctcctgagtagctgggactacaggggcacgctgccacgcccagctaaatttttttttttattttattagaggtgggatttcaccgtgttaccgaggctgctctcgaactcctgaactaaggcaatccaccctccttggcctcccaaagtgctcggattacaggtgtgagccactgcgcccggccttaaacgatttttaacagctggggtctatgttgcccaggctggcctcaagctcctgggctcgagcgatcctccctcctcagcctcccaagtagctgggattataggtactaatccagcatattttaaactacattttggtgggcgtgtgtctgtaacacatgcattttattcttgccaatatgtgggttaaaaaaacaatggaggctataaaccacaccattatgttaaaatgctgggatatagggggtaacagatgagttattttttgctttcaatttctgagttattttaaattgttcatatcatgcacatattacccttataaatagcaaaaactctaaagatgatcgtattttcagggaaaatgtattacagaagtggtaaacaacaagagaaaccctaagatattagagctcagagagaggtatcttatctgtcctttggctaaggagaagcaccattagttttatggaaaaggttacacaggaactggaccttgaaggattagtaatgttagtattaatatgatcaactcattatatttgactctaaagtgtctttctgcatgtgaagtatcatcatctagagagttactctcaaactcacttctttctcccttccacccagctcatcaacagaccgcctaacccagaaattaaatctgttgacaaatttgcctgtattgtctgtgccagtctatctatcttgtcatttatgcagccaagtaagaattgggtgggtatataagaggagcattaaaatttgatgtggattttattgagattcttcataatctttatattctttggcacagggcctacctatgtcctctggaaactagaaatgaaaaccagtatttattcaatgtagtattaattataattttaaaaactggaacaacccaaatatcagaaatacatgtatagtgtgtaggaaaaaaaaatcacagccatttaaaatatttacaaagaatttttaataacttagaagcttatgataaagaaaaaaagccagaaggcaaaattgtattcagtagaggcaaaaaattctgtttggggctcccatatgtctgcaacttcctgtaagaggttgaagacatgtcttcatattagcgctaacagtccagcttccttggttagcttatggtcaggaatgtgggacaaatgagatttttagtcatcttttgggttatttcctattaagactgtattctgtcaaagttttcccgcaataaagggtaggcactagggataccacatccaagagcttgacagaggaacaggtaaacaggtgaaagtggaatccgtgccccagagactccagggaatagagatggcggtaggtccaagccccaaaccaagtctgggtataactacacacactggggagaatgccagatccattcctgagtggaattcctggtaagtggtgggctctaggcttcacgttttcccacccacaaagtggtgatgggacaattctcatcataattggtacatttgcactggaacattctagactcaatcttactagtaaaagcacttccttatgaaagaaaaccacataacattcacagtcagggagcactttctttttaccagtagtaacccgagtatggtaccaggcaagcttgctttcacttataataaacatttattgaataaccataggagtggtaagtgccaaccacaatagggccctgtcttctagaggctggaattttgtactttgcaaatgtattttaagggcgcaagtgtttgctcttttgctacttgtctcaatggccacagacattatctagtctcgagtccagcagccctgggaaggtaaataaaaggaccgtggcaatctttcattcagcactctgcactgggtttctggtcacctgctggctggtgccaacctgccctggcctgagcaaggatggaagtagcaaaggtgatgaaggatgtgaagatacccttgtgggtggggatgaggggaagggcacatagagggcagcaagacaaggcctttggctgcttctgggaggccttgccaaaacttcccacctgtgttctgcagtcacacccttctgttaatcttgcactccaggctgtgcacagtttagggataacggccctctccagctacagcccagtttaccagtgactttcatccaaccatatccaccaggctgcatctttcccatcctttctttgaaagggccccagcttcagagttttggacgttaagtatgtgacttaaagatcctaaagataggatttctggtggccacaagactgtgaactcctaattagggtctaggtttgttttgaaataatattctggtctacacttgagtaattaaaatggtgaatgatctgtgagagtgattggttcaaggaatatgcctcatcaatttttaaactgaaaataagggcagggggcaaagaatgaccaagtaatgttctgttgcttttttttttttttttaagacagggtctcgccctgtcgcccaggctggagtgcagtggcacaatcatggctcactacagcttcaacctcctgggctcaagcagtctacctcagcctcccgaggagctgggactacaggtgaatgccaccatgcctgcctagtttttaacttttttgtggagacagtcttgctatattgcccaggctagtcttgaactcctggcttcaagcagtcctcctgcctcaacctccgaaagtgctgagattacaggcatgagccactgcacctggcctgtatttttttaatttcctttcagaacagtataataaaagtgtctttttctaaatatgggttattcatggcctattttaaatcctaagctggcttctgacaggcaagttccctttaggatcttagcttggctcccctcctgtccagtcctggtgtgtgcaggaaatacaaactgattttaatagtagtttacattaaatattattttaaaagtagatcacctgtgcgaatgaagtatttttctcaaacaaggtatgtccttagatcctgtgcctttgcctggttgtattggaagtcaagctgtaaatggaatttaagcaccatatatatatatatagagagagagagagagacagattcaaacccctgggctcaagtgatactcccgcctcagcctcccaagtagctgggattacaggcccgtgcaactacaaccagctgccttattactgacctgccctcttcactgtaaaaaccaggaaacatatcaccatgtcctagattttgtgaaaaacgtcttttgtgtctctcaaatggatcatgcttcatccggaacctctgagtccttgagacctccacgttccgggcggagcagggaagcctgaactttaagaaggccacgtggctaaatggcttccctgaggcatgtctctcctgggaaggcattccctaccccagatcctgcagcctttcatcctgaggccattagactctccaggtgcacctgcatcaaagcgcacaggtaccgcgctcctgatctggacttatctgaattgtaccttccccgagggtgctgtttgatgtgcttgattgtggaatgaaagccaaataaaggaatgagaggggctgtttatttcctcatttttagtgcttttcctcagggcccttctatgtctggagaaggaatttatgaaaaagcctaggataccacctaagcggaaaacaccagcatctacttacaattatattaactctggcatccatgagctgttggcctctggcagaggagtctgtgtccctaaagagctctatggatagccagtatggtggctcatgcctgtgatctcagcactttgggaggccggaatgggaggatcacttgagcccaggagctcaagaccaacctgggcaacatagtgagacctcgtctctaccaaaaaaaaaaaaaaaaaaaaaaaaattagcctggcatggtagcaggcacctgcagtcccagctactcaggaggctgaggcaggaggatcattcgaggccaggagtttgaggctgcagtgagctatgattgcaccactccagcccaggtgacagagtgaaagcccatctctgatagatagaaagatagatagctctatggtggaggaaagtgatgccactctcgcctcacactttttcagctgtgtcatcagcatcctctcttcctggaggagggtgacagggccagtgtagttctgagttgctctgatagcctgctgcttctcatttgagtgaccaaggctgggaatttagaagggactctagtcataataacataggcggcctccctgcaccccctccccctttttttttttgaggcagagtctcactctgtcgcccaggctggagtgccgtggtgcgatctcggctcattacaacctccgcctcccaggctcaagtgattctcctgcctcagcctcccgagtaactgggagtacaagcacatgccaccacatccagctgattttttgcatttttagtagagataggctttcaccatgttggccagactggtctggaactcctgacctcaggtgatctacccgcctaagcctctcagaatgctgggattacaggcataagccaccatgcccagccatcccccaccgccttttttttttttaacagatggggaaactgaggctgaggctgaaagcaattgagtgacttgtccactgttggcagcatgccagtggcagaggcaggaatagctcccaggattcattcctgactcctagcctagcaatctggtgatgaaacagggtgtggtggacaatcggcagagactttcaatgcattgaatctccattcaaaaagaaagggtcccctgcaagacaaagacagattgtccagagtgccagaacttcttaaactgccaaggaacttgcagtatactgaagattttactgaagttgtttttggtactgtttggtgctaaatacaaggaattggtttgttgtaaaagctatagggtgagactgccctctagtgggccagtggagctattggtctagctgtgttctgggcaactttgctttctcacgccacatcaatgtagagcgattattcctacggaaaggaatttcaattttattctttctcaagcactgtggcccatagtaactctgttgatctctaagcactagccatcatttgcgcgtcttatagaaggctgggtttgccttctatacatacacacattagaagtgtcttacttccctaacaagattcaggctcctaaaagccaggacatgcatgtatgtatgtatgtatatattttgtggagacagggtcttgctctgtcactcaggctagaatgaagtggtgcaatcacaacccaacctctacctcttgggctcaatcaaacctcctacctcagcctcccgagtagctgagactacagttacgtcctgccacacccagctaatttttctgttattttttagataatggggtcttgctatgttacctagactggtctcgaactccagccatgctatatcttaagtcttgtttttccacagcttctgccttgctgtccccttagctggacatggaattagaaggttctttgggatggaaaggaatccttcccccacctcccccaaaaagaatcccgtcacttctcatttgttcctaaaacattctaatctcatccctctgatcagtagttccccaagtagttgaatcatctgaatcccccagaaagcatacacaactcagtttcctgggcctgactccagccctgctcaatcagtctctgtggtttgagccaggaaacctgctttacaaacttcccaagtggcttttgatgtgtagccaggtctggcagccaactgcttcaaaaccccatttacaattatttttcacagctcccaccaccgacagtgtctccagaggtcttcagcttgtgtcacttattaaaattaaccattttgagactcattcagaaatactcaatatattcttctaactgggtgacatgggaaggaaaaaggaaccgcatgagatggaccaaaggcacttgctttggttgccaatggctctgaaacaggaaatactgaaaccaatacctctgtactgactgggcaggttgttgatgtgtaggttgttttcagtatttgggctggataggaagacaaaagtttgttaagttatcaattatgtattttcccctattataagtcatctgacctcatgattaccatacaaggtaggtgaaattgtcctctttaaaaaaaagttttctaattgacagataataattgtacatattcgtggggtacatagcaatatttcaatacatacaaggtatagtgatcagatcagggtaattcgcatatccattatctcaaacatttatcacttctttgtgttgggaatgtccttctcctagctatttgaaactatatgttattgttaactctagtcatcagtccccttctttatagatgggaaaattgaggattaggaaagtgaagtaacatccctgaagtcacctaagttggtaactgtcagattctgcatttgattacaggcctgattgccaaggccaactttgaaaaggtaagaggaccagagggccaacctgctgtttttttaactctggcaggccaagcgagcagtacagcggggagctactgcagtcatctttgatgtgtctgaaaacccagaagctattgatcaggtaagctcctcaggccatgccaacactgcagcctccctgagaaaggcacttcctttagtgagcttggcttgtcccggtcatgtcaccctcatctcagagcatttgctcttgtcttctgaagttaggtgtccatgtttggacataattcccaaaggaggtatactgggcgaggttaagagccagggaattggggcacagggggcattttctctttttttcccccgagatggagtcttgctctgtcacccaggctggagtgcagtggcgcaatttcagctcactgcaatctccacctcccgggttcaagcgattctcctgcctcagcctcccaagtatctggaattataggcacgagccaccacgcctggctaatttttgtgtttttagtagagatggggtttcaccatgttggccaggctggtcttgaactcttgaccttgtgatccatctgcctcggcctcccaaagtgctgggattataggcgtgagccactgcaccgggttcagggggcattttctaagacctttctgggccttctgcttgcccagtccatcccaaaacaagcgtcattctcagccttgctcttctgggagctccaaggctgtaatgttggaagagctggaggattccagacaggtattcagtgttccttccctccagcctttctttctctctactgcttcttaaagtaagcgcaccttttaaccagagccctctcttcttccttagctgaaccagggctctgaagacccgctcaagaggccggtggtgtatgtgaagggtgcagatgccattaagctgatgaacatcgtcaacaagcagaaagtggctcgagcaaggatccagcaccgccctcctcgagtgagcctccgcaccatttggcacaggctcggggccttctctgctactacctgtccctttatttcccttgggctttcattcctatctctgtctgaaatgctggcataccccaggttcctgcaggcttagatcagctattggactcaaggccagggtgaaattttactcatgttcctttatagtgaatttgagaaatcctaccagaaatagatacttttgtgctaagatgtctctggcctcttccacctggcattccctcttggccatctctcatcctttcttttccatcccatctccctctgaaaggcaaactgaggaggattgaagggatggggcatccagcacctggcttcccgtggcttccttcttctatctggcttagacactagaaaaaaaggcttgtatttccttcttcctgtagagtagattaccttattgaaactccccaagttaatttgagtctggaaaagttagctttcaactgggattgagttcgacggctaaatgaatagcatctgcatctcttaagtatgtagaagagacactactggccactaactcttaaccagcctcttctgctcaaacctcaagctgaagaattccaggaaccttgggctggtgccctatattggtgttatttcctcctcacaaatattgggacattcacagtgtaggatgattctttcccatacacaacatagccggttacatgcagcttccactttgcaaagctctattcccattggccaaatggaggtcccagataaggtggctgtgaggttttaggaggcagtgaggaaaaggtaagaactaaaactagagggagtttgctgaactgacttgttggcttctttttaaagggaaaaaaaaaagcgctttggtaaatatgactcattgtagtggaagctgatatttgtggaagcagcatacaattttctgagttgttgtaaaccattaattatacggttagtaatcactgttccctcaaaacatgacactcactcttttgtcctataaatgtgattatttgtgttgatttggaagggcctttcttaccagttacagccaactttgcagtattccacaggctttaccaacagagttcccttggctcttggggggcctggctgagatcgccacaggcgtccccctgggccacaccaaaggcactacatgggcctagggagcacaccatgtgcatgtgagcagaaccccaggagtttcctgcaaattgaggggaaactcatcccggtcaccccatctttatcctgacaaagccaagatagcccatgtgccgcttaccaggctggagagaggctgtgactcactgtgtctgtgttccgttccagcaacccactgaatactttgacatggggattttcctggctttcttcgtcgtggtctccttggtctgcctcatcctccttgtcaaaatcaagctgaagcagcgacgcagtcaggtagtgcctctgtgtgtagcccgtgagcagtaacccctcttgccgtgacactggggaaaaccaggactctcgtcaccttattttttgatggtgcaacatggagcctcacagctgtggactctgagctctgcagcctgttcccagtggcctagaaactgcaaagatggaaaaaaaataagagcaaactaggccaggcaccatgactcacgcttgtaatcccagcactttgggaggccgaggcaggcagatcacttgagctcacgagttcaagaccagcctagtcaacatggcaaaaccccgtctctaccaaaaatacaaaaattagctgggcatggtggcatgtacgtgtagtcccagctactcgggaggctgaggtgggaggatcacttgagcctagagggcagaggttgcaatgagctatgatcacaccactgcattccagcctgggtaacagagtaagaccctgtctcacaaaaaaaaaaaaaaaaaaaagatcaaaacttacagcccagtgccttctctgttctaaaagggctagtcctacaaaggttaagcattgggaatatctccagcaggtgtttcgaaggaagtgtttattttatttttttatttctttgagacaagatctcattctgtcacccaggctggagtgcaatggcatgatctcggctcactgcaacctccacctcccggggtcaactgagtctcatgccttagcctcccaagtagctggaattacaggcacccggctaatttttgtatttttaatagagacggggttttaccatgttggccagcctggtctcaaactcctaacctcatgtgatccgcccgcctcggcctcccaaaatgctgggattacaggcgtgagccaccacgcccgtcccaaaggaagtgtttaagtcaacgttaataagtattataaacactccacaggtctagaatatgtgctgtagcagtctgagttttgagtgctttctctgaagtctattctggcatgattgagaagtgtttgcctgtcccagtacatcaagtggcgccctagagccttggtcctcagatagaatctgtggtccagcagcaacggcagcacctggaagcctgatagaaatgcagggtctcaggctccgctccaggccacctacacagtataccaggctctctgggtgatgcttgattaacagtagctgctgtagcactgcagccacatcactttgtgcttgcaggaaggagaaactcgggtagggggtggtgagaggataagcagagatctggacccccaaatgtatggcagggtcatgtctcaggggagagatggtggatcttggaaggcaatctgtagagaagagaatcaccaaagttctcttgagggttgagcgaccacccccaacaagatgatggcttgtgttttttgagcacagcctatttgccaggtgctaagcacttacacattgtctatttactgtcaccacctccttcaacagaaagaggaggaacgcttggcgtagaacaggttgataactcggggtctggcagagttaggaggcagcaggtccaagtaattggaggagacccctgccttcaaatcagagagacccctgctagtcttgccacttaggaaaagcctaggttgatgtcgtggacaccccacgcgtctggagaatatgtgctatggcagtctgagttctgagcgacttctcagaagtctgttccggcatgatagagaattgtctgcctgtcccagtgaatcgtgtgtcatgtccctggggtgactgccactttcatacgtactggaccctcacacagactacattctgccctgcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggtaatggcagaagcaggcccgtcctgggtggggaaaacataggcaggtcagcagaggtgcccaagacctagaaggacagggccctgtgttccatcacacacatcaacttttagagtcactcttctgaaaattctgagacttgacttgatacttagctgggtgtttttacttacaaagagacaagggattttatatccctcacttttttttcttgtagctctttgaaaattttaggcctagtaccatgcctgtagtcctagctacttgggaggctgaggtggaaggatcacttgaggctaggaacttgaggctgcagtgagctattattacaccgctgcatatcagcctggacaacagagtgagactttgtctgtcttagaaaatttcagaccttcagaaaagactagtaccatagacgatatatgtcaggggcctagaatcatccatgatgaacattttgccacatttgctcactctccctctctctagacagatgcatacatacacatatttgcggggcagggagcaaaccacttgagaattacagacatttgatgcgcctttgttgaaaatgttccactgctgcagagactgttggatggaaatggaatttttgcagaatagaatagtagattcttacacagactctgggttctaatcctgacctgggtggattctagctttgtgatcttgggcaagtgacttcgttttcttgtgacatgggcctgacactgaccagcattccaggtgatcatgaaggttccatgagaagatccagggtagaccctttgtcattctgtcaggcacagtgttaggtgtgagctggaatattactgtactagacaggtcagaaaattgaaagacaaagtaaaatgagcaaatctggaagatgcttaggcttaggaactctggaggtggttctgtcccaataactctatctgtctagataggctgcttttcttataaaccacacaccccatggtgaggttcaggatccagtaaaggaggggatagcagagctttacccctttgctgccacacctgtcaatcatgagtcccaggtatcttcctttctactcatgcctatttgggatacccagggacagccagcacctcagagatgcagaatatcttggggtatacctggccctctctccatacccctaagcctcccatcctcactagcaggaggactcggccctccctgggtggaggcatgagtgtgtttgccctcctccagctacgggaaagacgcctgcctctgtgcgtgcccactcccttaacactgaggactgtggatggggctgactgctggcagtttccttcttcctagaacacatgggtgggccctgcttctagggaattgagccctaattggaggtggggaggagagtagggaagggcacgggcatgctgtgcagaactccttggtctatgctggactctgcaggaggacacacctgcgaggctgaaggcagacttgtgtcccctctctccctgcccaggagctgcgggtcatcccctgtactcaccggtttcacaggaagtgcgtggacccctggctgctgcagcaccacacctgcccccactgtcggcacaacatcataggtaactgtcacccgccttagccattgctgaagagtcaagtgcctagctagagtgtgacacacaccgcaggcttgggaacactcagaaccaccgtggcactgccctctggacttggaggcctggcagccctgggttttggaggttgtctgcacgacccttaggagagcttggcattaagaatcaccctgagttcaagtttgggcttcacattaagcagcttcttgacctcgggcaagacatctggcctctcctaggcctgaggcccctaatctctttagtggcaatgacagtaatggtgtttgcccacacccagtaccatgggggtgttcctaggaccacgagagacgatgagtgtgcagaggccagcttgggctgttgctcctgcatcactgtgtcattaaacagggatggagggacactggcatctttgaatccgattcttttctgcagacttctgtggtgccctgtcaggcagagcagtggggagttgggagcggggcccttacaggagatgggccatttcacacagacaggcaggtcagcctctgccgctgcagctcagtttgggggcagggttgtgagaatgggtaccttggcaggtgaccaagcctgctgcttcagcctttgcccgttttaaaaatccctttagcctctgacaccagtatgctcagccctgcctactctgtttcctccacttgtctccagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcgcagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggtgagagcaggaaatggcagtaggtcagagcaggagtttccatcagggtcgtcttgtcttctgtcttaggcattttctgaatgacttcttttgtgtccttggttttaaacaccatctgaggctgaagacttccaagggttactcctcagcctggccctcccttggagttcagacccattgagccctctgcttccatgatctcgggatctctccccaagatgcctgcagcctgtcatgtccacagcagtactcatttccccctctgccctgctccccatccgcatgctcacaccaaaaacctagcaccagctgggggtagtggctcatgcctctaatcttggctcacccaaccactttgggaggccgaggctgtggatcacttgaggccaggagttggagacagcctggccaacatggcaaaaccatggagtcggttcatgactcctcatggctgggatattatgtaggagccacttcataaacattctcgttactcagtacaaaagttagccaggggtggtggcgggtgcctgtagtcccagctactcaggatgctgaggcaggaaaatcacttgaacctggttggcagaggttgcagtgagccaagatcaagctactgcactccagcctgggtgacagagcgagactctgtcttaaaaaaaaaaaaaaaaaaaaaggcaggacccagtggctcatgcctgtaatccctgcactttgggagggcaaggcgtgtgaatcacttgagttcaggagttcgagaccagcttggccaatatggtgaaaccccatctctactaaaatacaaaaaaattagctgggcgtagcgggcacctgtaatcctagctactccggaggctgaggcaggagaatcgcctgaacctgggaggcggaggttgcagtgagccgcgctccagcctgagcgactccatctcaaaaaaaaaaaaaaaaaaacctaggccccatccctgtgcccaccctgccccttgcacttcagcctcctgggcttctcaacccgcctgtgaaggaccccagttgcttgtttttgcctcagtccatgaaaatgaattcccagaaaatgaaacttagcaaaagacatgtaagatacaagtccaggtattttattattagattcaacagacatcagattgctacaagatttccaaacatgctgtctcagtaataaactggagtctagcacctctgagtagcactgcaacaagatctacctgcaaagtacatcccaaatgtatctacttctctgcactcccactgctatcccctcagtccagtctcattttcctctcttcgggacagaggcaataacctctgactgatctgctgtcactggtcttgccttctattccacttggaaccagagtggccttttttgaaacataagttgatgtctttgtgctagaaaacccttcaatgacttgccattacctttaaaatcttaaaaatgttggccgggtgcggtgattcacgcctgtaatcccagcactttgggaggccaaggcaggcagatcaccaggtaaagagaccgaggccatcctggccaacatggcgaaaccccgtctctaataaaaatatgaaaattagccgggcgtggtggcgtgtgcctgtagttctacctactcgggaggctgaggcaggagaatcgcttgaacccgggacgccgttgttgcagtgagctgagatcgccccatcgtactccagcctggcgacagagcgagactccgtctcaaaaaaaaaaaaaaaaagttaactcctggctgagtgctttggaaggccaaggcaggaggatcacttgaggccaggagctggagaccagcctggggaacatagaatgaccctatctcttaaaaaaaaatttaaaaaaaaatttttttttaattagctgggcacggtgacacatgccattagtcccagatacccaggaggctgagcccaagagattgaggctgtagtcatgatctcaccactgcacttcagcctaggcaacacagcaagaccctgtctcaaaaataataataaatgttagcatctcactcagttctgtgtgatccagctcctgccaacccatctgatgagctcctggttcactctccttgcttcctgctttcacctcctgtggcccctgtcccgttcttcccatgtgccaagctcattccagcccccagacctgtccgctacttttctcctccagatcttaggttaggtaacactccagccccctctgagatcacctacacaccttctgttcacttctgtcatcctattgctaaattactttgtctcaaggttcgtaatctctgtgagggagtcctctctgctgcttttcccaaggcctgacgcacaccgggcacccagttaacatctttaatatattgggctttcgtgctacctgagggcttctagaaagctctctacatccaagtgagaggctggctctccaggaggtacctgtgctctcagcacaaatggagcccctctgggaacaggaacctgcttcagccctttagcatacacaggcctgccacatgctggggacagggccacctgagtcccttgcctggtcccatgtgtggtgccagctccctcccctgatgattgttctctctctttcccaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgtt

SEQ ID NO: 4 - DNA, 6851 bp, homo sapien
agaugaaagggccgcggcgcgacggccgggggagccgagcugagccugcgacccacaaagccgccgccgccgccgccgugauggggcugugaggcguccgcccgcguucgguccucagccggcccgcgacuaugcccggccgcgcccgcccuccgcgcccucccgccgcaggaccaugaggccgcgcucgggcgggcgcccaggggccacgggccgccgccgccgccgccugcgccgccgcccccgcggccuccggugcagccgccugccgccgccgccgccgcugccgcugcugcucgggcugcugcuggcggccgcggggcccggcgcggcgcgggccaaggagacggcguucguggagguggugcuguucgagucgagcccaagcggcgauuacaccaccuacaccaccggccucacgggccgcuucucgcgggccggggccacgcucagcgccgagggcgagaucgugcagaugcacccacugggccuauguaauaacaaugacgaagaggacuuguaugaauauggcuggguaggaguggugaagcuggaacagccagaauuggacccgaaaccaugccucacuguccuaggcaaggccaagcgagcaguacagcggggagcuacugcagucaucuuugaugugucugaaaacccagaagcuauugaucagcugaaccagggcucugaagacccgcucaagaggccggugguguaugugaagggugcagaugccauuaagcugaugaacaucgucaacaagcagaaaguggcucgagcaaggauccagcaccgcccuccucgacaacccacugaauacuuugacauggggauuuuccuggcuuucuucgucguggucuccuuggucugccucauccuccuugucaaaaucaagcugaagcagcgacgcagucagaauuccaugaacaggcuggcugugcaggcucuagagaagauggaaaccagaaaguucaacuccaagagcaaggggcgccgggaggggagcuguggggcccuggacacacucagcagcagcuccacguccgacugugccaucugucuggagaaguacauugauggagaggagcugcgggucauccccuguacucaccgguuucacaggaagugcguggaccccuggcugcugcagcaccacaccugcccccacugucggcacaacaucauagaacaaaagggaaacccaagcgcgguguguguggagaccagcaaccucucacguggucggcagcagagggugacccugccggugcauuaccccggccgcgugcacaggaccaacgccaucccagccuacccuacgaggacaagcauggacucccacggcaaccccgucaccuugcugaccauggaccggcacggggagcagagccucuauuccccgcagacccccgccuacauccgcagcuacccaccccuccaccuggaccacagccuggccgcucaccgcugcggccuggagcaccgggccuacuccccagcccaccccuuccgcaggcccaaguugaguggccgcagcuucuccaaggcagcuugcuucucccaguaugagaccauguaccagcacuacuacuuccagggccucagcuacccggagcaggaggggcaguccccaccuagccucgcaccccggggcccggcccgugccuuuccuccgagcggcaguggcagccugcucuuccccaccguggugcacguggccccgcccucccaccuggagagcggcagcacguccagcuucagcugcuaucacggccaccgcucggugugcaguggcuaccuggccgacugcccaggcagcgacagcagcagcagcagcagcuccggccagugccacuguuccuccagugacucugugguagacugcacugaggucagcaaccagggcguguacgggagcugcuccaccuuccgcagcucccucagcagcgacuaugaccccuucaucuaccgcagccggagccccugucgugccagugaggcggggggcucgggcagcucgggccggggaccugcccugugcuucgagggcuccccgccucccgaggagcucccggcggugcacagucauggugcugggcggggcgagccuuggccgggcccugccucucccucgggggaucagguguccaccugcagccuggagaugaacuacagcagcaacuccucccuggagcacagggggcccaauagcucuaccucagaaguggggcucgaggcuucuccuggggccgccccugaccucaggaggaccuggaaggggggccacgaguugccgucgugugccugcugcugcgagccccagcccuccccagccgggccuagcgccggagcagcuggcagcagcaccuuguuccuggggccccaccucuacgagggcucuggcccggcggguggggagccccagucaggaagcucccagggcuuguacggccuucaccccgaccauuugcccaggacagauggggugaaauacgagggucugcccugcugcuucuaugaagagaagcagguggcccgcgggggcggagggggcagcggcugcuacacugaggacuacucggugagugugcaguacacgcucaccgaggaaccaccgcccggcugcuaccccggggcccgggaccugagccagcgcauccccaucauuccagaggauguggacugugaucugggccugcccucggacugccaagggacccacagccucggcuccuggggugggacgcgaggcccggauaccccacggccccacaggggccugggagcaacccgggaagaggagcgggcucugugcugccaggcuagggcccuacugcggccuggcugcccuccggaggaggcgggugcugucagggccaacuucccuagugcccuccaggacacucaggaguccagcaccacugccacugaggcugcaggaccgagaucucacucagcagacagcagcagcccgggagccugagcucaggaggaacucuuaccuggaaauugggaacuguauggagacuccaaacugacuucuuucaaaaaacaaaaacaaaaaauuuuuuuagcuuugacaaacacacaaaagugguaauaaagagagcccuccuugucaacccaaaaugugagcccccuguggcaaaaccacccccuaccccauuaacaaaucaacagacaaaauucuccgaguccuuugccucuuuugauaacauguuguucuguuuuguaaagugugugugcuugggguuccgaggugugggauugaguucucugcuuuguuuuuuuuuaagauauuguauguaaauguaaaaaguuauuuaaauauauauuuuaaagaacccuaacugccaacuuuugcugaaaaagaaaaaaaaaucacugcugcauuaaaugaaccacaucauguguagauacuguugucucccugaagggagcucaggccuuugaaaagcucagggcuucaccugccuuagaaaaugaaccagaaacuugaaguaaagcuaguugauagggguacaggcucugaggagcagugcaaaacugccucuuucuuucucguggcaaaucccaauguacacgauuucaggucucagacgccaugccucuccagcccacgccuuuaggcaggugauggcagcagcuaggaauaggguguacaugauccacagcccugcggagccaggucaagccgcugcuaugaaagcuccagggugauggggacgauucugcccaguguccucagucuguccccucaggucauggucccaagugaaaugacagaguucacagcccuggucuuggcugagguccaggucauaguaagggcauguucuuggggcccucgaccugaacucugacccuccgggcagggaagaggagguuguccccuuugguuguccuggcuuuggaguccuuugcaaaaauauuuugggcccccugccacuggcugcagaaauggcucgacgggguguguggggacagacacccagaaggaauguacuuuuguggccuugguguccgauggggcugggggagagugcucuccacugacccagcagcacacccaugugcagugcgccugcaucugugugggggcagccacaccccuuggcugcugcuuccuugggcugccuuucugggggcaugugacuggaccuacgaggucugcacugagcuccauuugaaugauaccuuuccuaucccauuucccccacggaagcaccgcuucaggguuauucaguccucugccucauggcugaaauugcucaucucgucugcagaugucuacuauccugucuaccuaaugcacuauuauguauugauucuccaugagacagagagagagagagacuaucagauaguuuacacccaaaggguagguuuuuguauauuuuuccagccuuuuuuauuaaggggaaggggagaguuuaaaaacccaaaccguugugguuuuaagguguuucauuuuuaaaagggagagagaaucuauuuaaagcuauuucagaucagggauugucauccuuuuuuguccaauguauuccuuguucuuuaaaaaaauuuuuuuuagaggaaacuaauauuagucuuuguguucacuaacucuucuggucacuuguauuuauuuauucauucauucaucagauauuuguugccaucugaaagaacuggcccagugggucugaaagcucgcuugagaauaggaaacuugagaccuggcccccuguggguaggagaacaaggaccaccuggguucuccagucuugaacgagaaucucacucuuaucagaauguuuuucuuaaccucagcguaugaugaggaaauuuacuuaucucuagcuaggauuugacaaauuccaacaucaaaugaucaaaacauuugccacugaggcuucacuggugagauccguucuccguccucgggugcagucccuugggggcugcuccucggacugcgccccgcacaccuguuaucgagggugugagaagcgccuaagcuggugacaugugaucugggacgccuucauuucucgggccaggaguagcagcugcuaaggacagcagcuugcauugcgugguuuuagggaagcagggucuggcuuuuaauaugaacugcaaaaagcagcuucucacugauauuuuuuuguuguuguuucugggggguuuuuuuguuuuguuuuuaaugccuuugagugcauauuuucuuccucgucugaaaccgaacucccaaaguggcuuucuuuagcccuggcuggaaaaccaccucucaauagccuuaagcaauaaauagaugaguagagaauguggcuucaacugggcuuauuaaaguaagugugucuaguuuucacuugaacaagugauagcugcagauggcgaaagaaacccauuuaauuuuuguagcuuacaggugguagaaacaaaaaugcaauuuuaaaaccuuaaauaccaaauaccaaccauugccuuuuuuuuuuuugagauggaauuuugcucuugucacccaggcuggagugcaauggcgcgaucucaccucacugcaaccucugccucccggguccaagugauucuccugccucagccucccaaguagcugggauuacaggcaugcgccaccacacccagcuaauuuuguauuuuugguagagacaggguaucuccauguuggucaggcuggucuuggauucccgaccucaggugauccgcccaccucggccucccaaagugcugggauuacaggcgugagccaccaugccugcccagcaauaccaaccauugucuuuuaaauucguguuggcuucucagacagggagaucacuggaauaaaauaaccgauggucuuauuuugucacacguaaaucaaaagaaauguccucuuugaaguuguaagacuccaccaaugacagacacccuuuucgguggacucugagugguguguagugguuuuauagccauggaaacuaggaguaucucacuuuccacugagaaccccugcccccaaucccucuaaguugggguguggcaguugggcagggucaagugacccagcccuggcuguaggacagccauauacagugaagaguucuagaaccagcuaaaaauggaaguuuggguguuuaccaacaagguaccucuuuauggaugcagccccaguaagcuggcuuuaacucucagcuccuucccugucuccuccuaauccaagcccuuuuauaaaauaaagccccuucugucccacugcucacauacuuaugugcugcuagucucuacucgaaguucgugcaggacuaaugcuuuuaaaaugaggucuaaaaaauaauuacuagucgagacuauuauucuuuaaacagaacugccuuuuucuacucuuuauguaaacucuuucuauuguguuggucuaacaaggcacuauuuuaaaauuuuuuaauuuuucccauagcacuuaaaagagauuuuguaaagaccuugcuguaaagauuuuguaauaaaauggucuaagggcucuuuuuccaacauuaccauuuuuaaaaaauguuuuaaaagcuagaagacaacuuauguauauucuguauauguauagcagcacauuucauuuauggaaauauguucucagaauauuuauuuacuaauauauuuaucuuaagccaugucuuauguugagagugugacauuguuggaauaaucauugaaaaugacuaacacaagacccuguaaauacaugauaauugcacacagauuuuacauauuugcagaccaaaaaugauuuaaaacaaguuguagucuucuaugguuuuguaacaaauuguacacaugacuguaaaaaaaaaauacaauuuuaucaaguauguguu

SEQ ID NO: 5 - DNA, 6542 bp, homo sapien
gcggccgcggggcccggcgcggcgcgggccaaggagacggcguucguggagguggugcuguucgagucgagcccaagcggcgauuacaccaccuacaccaccggccucacgggccgcuucucgcgggccggggccacgcucagcgccgagggcgagaucgugcagaugcacccacugggccuauguaauaacaaugacgaagaggacuuguaugaauauggcuggguaggaguggugaagcuggaacagccagaauuggacccgaaaccaugccucacuguccuaggcaaggccaagcgagcaguacagcggggagcuacugcagucaucuuugaugugucugaaaacccagaagcuauugaucagcugaaccagggcucugaagacccgcucaagaggccggugguguaugugaagggugcagaugccauuaagcugaugaacaucgucaacaagcagaaaguggcucgagcaaggauccagcaccgcccuccucgacaacccacugaauacuuugacauggggauuuuccuggcuuucuucgucguggucuccuuggucugccucauccuccuugucaaaaucaagcugaagcagcgacgcagucagaauuccaugaacaggcuggcugugcaggcucuagagaagauggaaaccagaaaguucaacuccaagagcaaggggcgccgggaggggagcuguggggcccuggacacacucagcagcagcuccacguccgacugugccaucugucuggagaaguacauugauggagaggagcugcgggucauccccuguacucaccgguuucacaggaagugcguggaccccuggcugcugcagcaccacaccugcccccacugucggcacaacaucauagaacaaaagggaaacccaagcgcgguguguguggagaccagcaaccucucacguggucggcagcagagggugacccugccggugcauuaccccggccgcgugcacaggaccaacgccaucccagccuacccuacgaggacaagcauggacucccacggcaaccccgucaccuugcugaccauggaccggcacggggagcagagccucuauuccccgcagacccccgccuacauccgcagcuacccaccccuccaccuggaccacagccuggccgcucaccgcugcggccuggagcaccgggccuacuccccagcccaccccuuccgcaggcccaaguugaguggccgcagcuucuccaaggcagcuugcuucucccaguaugagaccauguaccagcacuacuacuuccagggccucagcuacccggagcaggaggggcaguccccaccuagccucgcaccccggggcccggcccgugccuuuccuccgagcggcaguggcagccugcucuuccccaccguggugcacguggccccgcccucccaccuggagagcggcagcacguccagcuucagcugcuaucacggccaccgcucggugugcaguggcuaccuggccgacugcccaggcagcgacagcagcagcagcagcagcuccggccagugccacuguuccuccagugacucugugguagacugcacugaggucagcaaccagggcguguacgggagcugcuccaccuuccgcagcucccucagcagcgacuaugaccccuucaucuaccgcagccggagccccugucgugccagugaggcggggggcucgggcagcucgggccggggaccugcccugugcuucgagggcuccccgccucccgaggagcucccggcggugcacagucauggugcugggcggggcgagccuuggccgggcccugccucucccucgggggaucagguguccaccugcagccuggagaugaacuacagcagcaacuccucccuggagcacagggggcccaauagcucuaccucagaaguggggcucgaggcuucuccuggggccgccccugaccucaggaggaccuggaaggggggccacgaguugccgucgugugccugcugcugcgagccccagcccuccccagccgggccuagcgccggagcagcuggcagcagcaccuuguuccuggggccccaccucuacgagggcucuggcccggcggguggggagccccagucaggaagcucccagggcuuguacggccuucaccccgaccauuugcccaggacagauggggugaaauacgagggucugcccugcugcuucuaugaagagaagcagguggcccgcgggggcggagggggcagcggcugcuacacugaggacuacucggugagugugcaguacacgcucaccgaggaacccccgcccggcugcuaccccggggcccgggaccugagccagcgcauccccaucauuccagaggauguggacugugaucugggccugcccucggacugccaagggacccacagccucggcuccuggggugggacgcgaggcccggauaccccacggccccacaggggccugggagcaacccgggaagaggagcgggcucugugcugccaggcuagggcccuacugcggccuggcugcccuccggaggaggcgggugcugucagggccaacuucccuagugcccuccaggacacucaggaguccagcaccacugccacugaggcugcaggaccgagaucucacucagcagacagcagcagcccgggagccugagcucaggaggaacucuuaccuggaaauugggaacuguauggagacuccaaacugacuucuuucaaaaaacaaaaacaaaaaauuuuuuuagcuuugacaaacacacaaaagugguaauaaagagagcccuccuugucaacccaaaaugugagcccccuguggcaaaaccacccccuaccccauuaacaaaucaacagacaaaauucuccgaguccuuugccucuuuugauaacauguuguucuguuuuguaaagugugugugcuugggguuccgaggugugggauugaguucucugcuuuguuuuuuuuuaagauauuguauguaaauguaaaaaguuauuuaaauauauauuuuaaagaacccuaacugccaacuuuugcugaaaaagaaaaaaaaaaucacugcugcauuaaaugaaccacaucauguguagauacuguugucucccugaagggagcucaggccuuugaaaagcucagggcuucaccugccuuagaaaaugaaccagaaacuugaaguaaagcuaguugauagggguacaggcucugaggagcagugcaaaacugccucuuucuuucucguggcaaaucccaauguacacgauuucaggucucagacgccaugccucuccagcccacgccuuuaggcaggugauggcagcagcuaggaauaggguguacaugauccacagcccugcggagccaggucaagccgcugcuaugaaagcuccagggugauggggacgauucugcccaguguccucagucuguccccucaggucauggucccaagugaaaugacagaguucacagcccuggucuuggcugagguccaggucauaguaagggcauguucuuggggcccucgaccugaacucugacccuccgggcagggaagaggagguuguccccuuugguuguccuggcuuuggaguccuuugcaaaaauauuuugggcccccugccacuggcugcagaaauggcucgacgggguguguggggacagacacccagaaggaauguacuuuuguggccuugguguccgauggggcugggggagagugcucuccacugacccagcagcacacccaugugcagugcgccugcaucugugugggggcagccacaccccuuggcugcugcuuccuugggcugccuuucugggggcaugugacuggaccuacgaggucugcacugagcuccauuugaaugauaccuuuccuaucccauuucccccacggaagcaccgcuucaggguuauucaguccucugccucauggcugaaauugcucaucucgucugcagaugucuacuauccugucuaccuaaugcacuauuauguauugauucuccaugagacagagagagagagagacuaucagauaguuuacacccaaaggguagguuuuuguauauuuuuccagccuuuuuuauuaaggggaaggggagaguuuaaaaacccaaaccguugugguuuuaagguguuucauuuuuaaaagggagagagaaucuauuuaaagcuauuucagaucagggauugucauccuuuuuuguccaauguauuccuuguucuuuaaaaaaauuuuuuuuagaggaaacuaauauuagucuuuguguucacuaacucuucuggucacuuguauuuauuuauucauucauucaucagauauuuguugccaucugaaagaacuggcccagugggucugaaagcucgcuugagaauaggaaacuugagaccuggcccccuguggguaggagaacaaggaccaccuggguucuccagucuugaacgagaaucucacucuuaucagaauguuuuucuuaaccucagcguaugaugaggaaauuuacuuaucucuagcuaggauuugacaaauuccaacaucaaaugaucaaaacauuugccacugaggcuucacuggugagauccguucuccguccucgggugcagucccuugggggcugcuccucggacugcgccccgcacaccuguuaucgagggugugagaagcgccuaagcuggugacaugugaucugggacgccuucauuucucgggccaggaguagcagcugcuaaggacagcagcuugcauugcgugguuuuagggaagcagggucuggcuuuuaauaugaacugcaaaaagcagcuucucacugauauuuuuuuguuguuguuucugggggguuuuuuuguuuuguuuuuaaugccuuugagugcauauuuucuuccucgucugaaaccgaacucccaaaguggcuuucuuuagcccuggcuggaaaaccaccucucaauagccuuaagcaauaaauagaugaguagagaauguggcuucaacugggcuuauuaaaguaagugugucuaguuuucacuugaacaagugauagcugcagauggcgaaagaaacccauuuaauuuuuguagcuuacaggugguagaaacaaaaaugcaauuuuaaaaccuuaaauaccaaauaccaaccauugccuuuuuuuuuuuugagauggaauuuugcucuugucacccaggcuggagugcaauggcgcgaucucaccucacugcaaccucugccucccggguccaagugauucuccugccucagccucccaaguagcugggauuacaggcaugcgccaccacacccagcuaauuuuguauuuuugguagagacaggguaucuccauguuggucaggcuggucuuggauucccgaccucaggugauccgcccaccucggccucccaaagugcugggauuacaggcgugagccaccaugccugcccagcaauaccaaccauugucuuuuaaauucguguuggcuucucagacagggagaucacuggaauaaaauaaccgauggucuuauuuugucacacguaaaucaaaagaaauguccucuuugaaguuguaagacuccaccaaugacagacacccuuuucgguggacucugagugguguguagugguuuuauagccauggaaacuaggaguaucucacuuuccacugagaaccccugcccccaaucccucuaaguugggguguggcaguugggcagggucaagugacccagcccuggcuguaggacagccauauacagugaagaguucuagaaccagcuaaaaauggaaguuuggguguuuaccaacaagguaccucuuuauggaugcagccccaguaagcuggcuuuaacucucagcuccuucccugucuccuccuaauccaagcccuuuuauaaaauaaagccccuucugucccacugcucacauacuuaugugcugcuagucucuacucgaaguucgugcaggacuaaugcuuuuaaaaugaggucuaaaaaauaauuacuagucgagacuauuauucuuuaaacagaacugccuuuuucuacucuuuauguaaacucuuucuauuguguuggucuaacaaggcacuauuuuaaaauuuuuuaauuuuucccauagcacuuaaaagagauuuuguaaagaccuugcuguaaagauuuuguaauaaaauggucuaagggcucuuuuuccaacauuaccauuuuuaaaaaauguuuuaaaagcuagaagacaacuuauguauauucuguauauguauagcagcacauuucauuuauggaaauauguucucagaauauuuauuuacuaauauauuuaucuuaagccaugucuuauguugagagugugacauuguuggaauaaucauugaaaaugacuaacacaagacccuguaaauacaugauaauugcacacagauuuuacauauuugcagaccaaaaaugauuuaaaacaaguuguagucuucuaugguuuuguaacaaauuguacacaugacuguaaaaaaaaaauacaauuuuaucaaguauguguu

SEQ ID NO: 6 - DNA, 6850 bp, homo sapien
agaugaaagggccgcggcgcgacggccgggggagccgagcugagccugcgacccacaaagccgccgccgccgccgccgugauggggcugugaggcguccgcccgcguucgguccucagccggcccgcgacuaugcccggccgcgcccgcccuccgcgcccucccgccgcaggaccaugaggccgcgcucgggcgggcgcccaggggccacgggccgccgccgccgccgccugcgccgccgcccccgcggccuccggugcagccgccugccgccgccgccgccgcugccgcugcugcucgggcugcugcuggcggccgcggggcccggcgcggcgcgggccaaggagacggcguucguggagguggugcuguucgagucgagcccaagcggcgauuacaccaccuacaccaccggccucacgggccgcuucucgcgggccggggccacgcucagcgccgagggcgagaucgugcagaugcacccacugggccuauguaauaacaaugacgaagaggacuuguaugaauauggcuggguaggaguggugaagcuggaacagccagaauuggacccgaaaccaugccucacuguccuaggcaaggccaagcgagcaguacagcggggagcuacugcagucaucuuugaugugucugaaaacccagaagcuauugaucagcugaaccagggcucugaagacccgcucaagaggccggugguguaugugaagggugcagaugccauuaagcugaugaacaucgucaacaagcagaaaguggcucgagcaaggauccagcaccgcccuccucgacaacccacugaauacuuugacauggggauuuuccuggcuuucuucgucguggucuccuuggucugccucauccuccuugucaaaaucaagcugaagcagcgacgcagucagaauuccaugaacaggcuggcugugcaggcucuagagaagauggaaaccagaaaguucaacuccaagagcaaggggcgccgggaggggagcuguggggcccuggacacacucagcagcagcuccacguccgacugugccaucugucuggagaaguacauugauggagaggagcugcgggucauccccuguacucaccgguuucacaggaagugcguggaccccuggcugcugcagcaccacaccugcccccacugucggcacaacaucauagaacaaaagggaaacccaagcgcgguguguguggagaccagcaaccucucacguggucggcagcagagggugacccugccggugcauuaccccggccgcgugcacaggaccaacgccaucccagccuacccuacgaggacaagcauggacucccacggcaaccccgucaccuugcugaccauggaccggcacggggagcagagccucuauuccccgcagacccccgccuacauccgcagcuacccaccccuccaccuggaccacagccuggccgcucaccgcugcggccuggagcaccgggccuacuccccagcccaccccuuccgcaggcccaaguugaguggccgcagcuucuccaaggcagcuugcuucucccaguaugagaccauguaccagcacuacuacuuccagggccucagcuacccggagcaggaggggcaguccccaccuagccucgcaccccggggcccggcccgugccuuuccuccgagcggcaguggcagccugcucuuccccaccguggugcacguggccccgcccucccaccuggagagcggcagcacguccagcuucagcugcuaucacggccaccgcucggugugcaguggcuaccuggccgacugcccaggcagcgacagcagcagcagcagcagcuccggccagugccacuguuccuccagugacucugugguagacugcacugaggucagcaaccagggcguguacgggagcugcuccaccuuccgcagcucccucagcagcgacuaugaccccuucaucuaccgcagccggagccccugucgugccagugaggcggggggcucgggcagcucgggccggggaccugcccugugcuucgagggcuccccgccucccgaggagcucccggcggugcacagucauggugcugggcggggcgagccuuggccgggcccugccucucccucgggggaucagguguccaccugcagccuggagaugaacuacagcagcaacuccucccuggagcacagggggcccaauagcucuaccucagaaguggggcucgaggcuucuccuggggccgccccugaccucaggaggaccuggaaggggggccacgaguugccgucgugugccugcugcugcgagccccagcccuccccagccgggccuagcgccggagcagcuggcagcagcaccuuguuccuggggccccaccucuacgagggcucuggcccggcggguggggagccccagucaggaagcucccagggcuuguacggccuucaccccgaccauuugcccaggacagauggggugaaauacgagggucugcccugcugcuucuaugaagagaagcagguggcccgcgggggcggagggggcagcggcugcuacacugaggacuacucggugagugugcaguacacgcucaccgaggaaccaccgcccggcugcuaccccggggcccgggaccugagccagcgcauccccaucauuccagaggauguggacugugaucugggccugcccucgacugccaagggacccacagccucggcuccuggggugggacgcgaggcccggauaccccacggccccacaggggccugggagcaacccgggaagaggagcgggcucugugcugccaggcuagggcccuacugcggccuggcugcccuccggaggaggcgggugcugucagggccaacuucccuagugcccuccaggacacucaggaguccagcaccacugccacugaggcugcaggaccgagaucucacucagcagacagcagcagcccgggagccugagcucaggaggaacucuuaccuggaaauugggaacuguauggagacuccaaacugacuucuuucaaaaaacaaaaacaaaaaauuuuuuuagcuuugacaaacacacaaaagugguaauaaagagagcccuccuugucaacccaaaaugugagcccccuguggcaaaaccacccccuaccccauuaacaaaucaacagacaaaauucuccgaguccuuugccucuuuugauaacauguuguucuguuuuguaaagugugugugcuugggguuccgaggugugggauugaguucucugcuuuguuuuuuuuuaagauauuguauguaaauguaaaaaguuauuuaaauauauauuuuaaagaacccuaacugccaacuuuugcugaaaaagaaaaaaaaaucacugcugcauuaaaugaaccacaucauguguagauacuguugucucccugaagggagcucaggccuuugaaaagcucagggcuucaccugccuuagaaaaugaaccagaaacuugaaguaaagcuaguugauagggguacaggcucugaggagcagugcaaaacugccucuuucuuucucguggcaaaucccaauguacacgauuucaggucucagacgccaugccucuccagcccacgccuuuaggcaggugauggcagcagcuaggaauaggguguacaugauccacagcccugcggagccaggucaagccgcugcuaugaaagcuccagggugauggggacgauucugcccaguguccucagucuguccccucaggucauggucccaagugaaaugacagaguucacagcccuggucuuggcugagguccaggucauaguaagggcauguucuuggggcccucgaccugaacucugacccuccgggcagggaagaggagguuguccccuuugguuguccuggcuuuggaguccuuugcaaaaauauuuugggcccccugccacuggcugcagaaauggcucgacgggguguguggggacagacacccagaaggaauguacuuuuguggccuugguguccgauggggcugggggagagugcucuccacugacccagcagcacacccaugugcagugcgccugcaucugugugggggcagccacaccccuuggcugcugcuuccuugggcugccuuucugggggcaugugacuggaccuacgaggucugcacugagcuccauuugaaugauaccuuuccuaucccauuucccccacggaagcaccgcuucaggguuauucaguccucugccucauggcugaaauugcucaucucgucugcagaugucuacuauccugucuaccuaaugcacuauuauguauugauucuccaugagacagagagagagagagacuaucagauaguuuacacccaaaggguagguuuuuguauauuuuuccagccuuuuuuauuaaggggaaggggagaguuuaaaaacccaaaccguugugguuuuaagguguuucauuuuuaaaagggagagagaaucuauuuaaagcuauuucagaucagggauugucauccuuuuuuguccaauguauuccuuguucuuuaaaaaaauuuuuuuuagaggaaacuaauauuagucuuuguguucacuaacucuucuggucacuuguauuuauuuauucauucauucaucagauauuuguugccaucugaaagaacuggcccagugggucugaaagcucgcuugagaauaggaaacuugagaccuggcccccuguggguaggagaacaaggaccaccuggguucuccagucuugaacgagaaucucacucuuaucagaauguuuuucuuaaccucagcguaugaugaggaaauuuacuuaucucuagcuaggauuugacaaauuccaacaucaaaugaucaaaacauuugccacugaggcuucacuggugagauccguucuccguccucgggugcagucccuugggggcugcuccucggacugcgccccgcacaccuguuaucgagggugugagaagcgccuaagcuggugacaugugaucugggacgccuucauuucucgggccaggaguagcagcugcuaaggacagcagcuugcauugcgugguuuuagggaagcagggucuggcuuuuaauaugaacugcaaaaagcagcuucucacugauauuuuuuuguuguuguuucugggggguuuuuuuguuuuguuuuuaaugccuuugagugcauauuuucuuccucgucugaaaccgaacucccaaaguggcuuucuuuagcccuggcuggaaaaccaccucucaauagccuuaagcaauaaauagaugaguagagaauguggcuucaacugggcuuauuaaaguaagugugucuaguuuucacuugaacaagugauagcugcagauggcgaaagaaacccauuuaauuuuuguagcuuacaggugguagaaacaaaaaugcaauuuuaaaaccuuaaauaccaaauaccaaccauugccuuuuuuuuuuuugagauggaauuuugcucuugucacccaggcuggagugcaauggcgcgaucucaccucacugcaaccucugccucccggguccaagugauucuccugccucagccucccaaguagcugggauuacaggcaugcgccaccacacccagcuaauuuuguauuuuugguagagacaggguaucuccauguuggucaggcuggucuuggauucccgaccucaggugauccgcccaccucggccucccaaagugcugggauuacaggcgugagccaccaugccugcccagcaauaccaaccauugucuuuuaaauucguguuggcuucucagacagggagaucacuggaauaaaauaaccgauggucuuauuuugucacacguaaaucaaaagaaauguccucuuugaaguuguaagacuccaccaaugacagacacccuuuucgguggacucugagugguguguagugguuuuauagccauggaaacuaggaguaucucacuuuccacugagaaccccugcccccaaucccucuaaguugggguguggcaguugggcagggucaagugacccagcccuggcuguaggacagccauauacagugaagaguucuagaaccagcuaaaaauggaaguuuggguguuuaccaacaagguaccucuuuauggaugcagccccaguaagcuggcuuuaacucucagcuccuucccugucuccuccuaauccaagcccuuuuauaaaauaaagccccuucugucccacugcucacauacuuaugugcugcuagucucuacucgaaguucgugcaggacuaaugcuuuuaaaaugaggucuaaaaaauaauuacuagucgagacuauuauucuuuaaacagaacugccuuuuucuacucuuuauguaaacucuuucuauuguguuggucuaacaaggcacuauuuuaaaauuuuuuaauuuuucccauagcacuuaaaagagauuuuguaaagaccuugcuguaaagauuuuguaauaaaauggucuaagggcucuuuuuccaacauuaccauuuuuaaaaaauguuuuaaaagcuagaagacaacuuauguauauucuguauauguauagcagcacauuucauuuauggaaauauguucucagaauauuuauuuacuaauauauuuaucuuaagccaugucuuauguugagagugugacauuguuggaauaaucauugaaaaugacuaacacaagacccuguaaauacaugauaauugcacacagauuuuacauauuugcagaccaaaaaugauuuaaaacaaguuguagucuucuaugguuuuguaacaaauuguacacaugacuguaaaaaaaaaauacaauuuuaucaaguauguguu

SEQ ID NO: 7 - DNA, 6541 bp, homo sapien
gcggccgcggggcccggcgcggcgcgggccaaggagacggcguucguggagguggugcuguucgagucgagcccaagcggcgauuacaccaccuacaccaccggccucacgggccgcuucucgcgggccggggccacgcucagcgccgagggcgagaucgugcagaugcacccacugggccuauguaauaacaaugacgaagaggacuuguaugaauauggcuggguaggaguggugaagcuggaacagccagaauuggacccgaaaccaugccucacuguccuaggcaaggccaagcgagcaguacagcggggagcuacugcagucaucuuugaugugucugaaaacccagaagcuauugaucagcugaaccagggcucugaagacccgcucaagaggccggugguguaugugaagggugcagaugccauuaagcugaugaacaucgucaacaagcagaaaguggcucgagcaaggauccagcaccgcccuccucgacaacccacugaauacuuugacauggggauuuuccuggcuuucuucgucguggucuccuuggucugccucauccuccuugucaaaaucaagcugaagcagcgacgcagucagaauuccaugaacaggcuggcugugcaggcucuagagaagauggaaaccagaaaguucaacuccaagagcaaggggcgccgggaggggagcuguggggcccuggacacacucagcagcagcuccacguccgacugugccaucugucuggagaaguacauugauggagaggagcugcgggucauccccuguacucaccgguuucacaggaagugcguggaccccuggcugcugcagcaccacaccugcccccacugucggcacaacaucauagaacaaaagggaaacccaagcgcgguguguguggagaccagcaaccucucacguggucggcagcagagggugacccugccggugcauuaccccggccgcgugcacaggaccaacgccaucccagccuacccuacgaggacaagcauggacucccacggcaaccccgucaccuugcugaccauggaccggcacggggagcagagccucuauuccccgcagacccccgccuacauccgcagcuacccaccccuccaccuggaccacagccuggccgcucaccgcugcggccuggagcaccgggccuacuccccagcccaccccuuccgcaggcccaaguugaguggccgcagcuucuccaaggcagcuugcuucucccaguaugagaccauguaccagcacuacuacuuccagggccucagcuacccggagcaggaggggcaguccccaccuagccucgcaccccggggcccggcccgugccuuuccuccgagcggcaguggcagccugcucuuccccaccguggugcacguggccccgcccucccaccuggagagcggcagcacguccagcuucagcugcuaucacggccaccgcucggugugcaguggcuaccuggccgacugcccaggcagcgacagcagcagcagcagcagcuccggccagugccacuguuccuccagugacucugugguagacugcacugaggucagcaaccagggcguguacgggagcugcuccaccuuccgcagcucccucagcagcgacuaugaccccuucaucuaccgcagccggagccccugucgugccagugaggcggggggcucgggcagcucgggccggggaccugcccugugcuucgagggcuccccgccucccgaggagcucccggcggugcacagucauggugcugggcggggcgagccuuggccgggcccugccucucccucgggggaucagguguccaccugcagccuggagaugaacuacagcagcaacuccucccuggagcacagggggcccaauagcucuaccucagaaguggggcucgaggcuucuccuggggccgccccugaccucaggaggaccuggaaggggggccacgaguugccgucgugugccugcugcugcgagccccagcccuccccagccgggccuagcgccggagcagcuggcagcagcaccuuguuccuggggccccaccucuacgagggcucuggcccggcggguggggagccccagucaggaagcucccagggcuuguacggccuucaccccgaccauuugcccaggacagauggggugaaauacgagggucugcccugcugcuucuaugaagagaagcagguggcccgcgggggcggagggggcagcggcugcuacacugaggacuacucggugagugugcaguacacgcucaccgaggaacccccgcccggcugcuaccccggggcccgggaccugagccagcgcauccccaucauuccagaggauguggacugugaucugggccugcccucgacugccaagggacccacagccucggcuccuggggugggacgcgaggcccggauaccccacggccccacaggggccugggagcaacccgggaagaggagcgggcucugugcugccaggcuagggcccuacugcggccuggcugcccuccggaggaggcgggugcugucagggccaacuucccuagugcccuccaggacacucaggaguccagcaccacugccacugaggcugcaggaccgagaucucacucagcagacagcagcagcccgggagccugagcucaggaggaacucuuaccuggaaauugggaacuguauggagacuccaaacugacuucuuucaaaaaacaaaaacaaaaaauuuuuuuagcuuugacaaacacacaaaagugguaauaaagagagcccuccuugucaacccaaaaugugagcccccuguggcaaaaccacccccuaccccauuaacaaaucaacagacaaaauucuccgaguccuuugccucuuuugauaacauguuguucuguuuuguaaagugugugugcuugggguuccgaggugugggauugaguucucugcuuuguuuuuuuuuaagauauuguauguaaauguaaaaaguuauuuaaauauauauuuuaaagaacccuaacugccaacuuuugcugaaaaagaaaaaaaaaaucacugcugcauuaaaugaaccacaucauguguagauacuguugucucccugaagggagcucaggccuuugaaaagcucagggcuucaccugccuuagaaaaugaaccagaaacuugaaguaaagcuaguugauagggguacaggcucugaggagcagugcaaaacugccucuuucuuucucguggcaaaucccaauguacacgauuucaggucucagacgccaugccucuccagcccacgccuuuaggcaggugauggcagcagcuaggaauaggguguacaugauccacagcccugcggagccaggucaagccgcugcuaugaaagcuccagggugauggggacgauucugcccaguguccucagucuguccccucaggucauggucccaagugaaaugacagaguucacagcccuggucuuggcugagguccaggucauaguaagggcauguucuuggggcccucgaccugaacucugacccuccgggcagggaagaggagguuguccccuuugguuguccuggcuuuggaguccuuugcaaaaauauuuugggcccccugccacuggcugcagaaauggcucgacgggguguguggggacagacacccagaaggaauguacuuuuguggccuugguguccgauggggcugggggagagugcucuccacugacccagcagcacacccaugugcagugcgccugcaucugugugggggcagccacaccccuuggcugcugcuuccuugggcugccuuucugggggcaugugacuggaccuacgaggucugcacugagcuccauuugaaugauaccuuuccuaucccauuucccccacggaagcaccgcuucaggguuauucaguccucugccucauggcugaaauugcucaucucgucugcagaugucuacuauccugucuaccuaaugcacuauuauguauugauucuccaugagacagagagagagagagacuaucagauaguuuacacccaaaggguagguuuuuguauauuuuuccagccuuuuuuauuaaggggaaggggagaguuuaaaaacccaaaccguugugguuuuaagguguuucauuuuuaaaagggagagagaaucuauuuaaagcuauuucagaucagggauugucauccuuuuuuguccaauguauuccuuguucuuuaaaaaaauuuuuuuuagaggaaacuaauauuagucuuuguguucacuaacucuucuggucacuuguauuuauuuauucauucauucaucagauauuuguugccaucugaaagaacuggcccagugggucugaaagcucgcuugagaauaggaaacuugagaccuggcccccuguggguaggagaacaaggaccaccuggguucuccagucuugaacgagaaucucacucuuaucagaauguuuuucuuaaccucagcguaugaugaggaaauuuacuuaucucuagcuaggauuugacaaauuccaacaucaaaugaucaaaacauuugccacugaggcuucacuggugagauccguucuccguccucgggugcagucccuugggggcugcuccucggacugcgccccgcacaccuguuaucgagggugugagaagcgccuaagcuggugacaugugaucugggacgccuucauuucucgggccaggaguagcagcugcuaaggacagcagcuugcauugcgugguuuuagggaagcagggucuggcuuuuaauaugaacugcaaaaagcagcuucucacugauauuuuuuuguuguuguuucugggggguuuuuuuguuuuguuuuuaaugccuuugagugcauauuuucuuccucgucugaaaccgaacucccaaaguggcuuucuuuagcccuggcuggaaaaccaccucucaauagccuuaagcaauaaauagaugaguagagaauguggcuucaacugggcuuauuaaaguaagugugucuaguuuucacuugaacaagugauagcugcagauggcgaaagaaacccauuuaauuuuuguagcuuacaggugguagaaacaaaaaugcaauuuuaaaaccuuaaauaccaaauaccaaccauugccuuuuuuuuuuuugagauggaauuuugcucuugucacccaggcuggagugcaauggcgcgaucucaccucacugcaaccucugccucccggguccaagugauucuccugccucagccucccaaguagcugggauuacaggcaugcgccaccacacccagcuaauuuuguauuuuugguagagacaggguaucuccauguuggucaggcuggucuuggauucccgaccucaggugauccgcccaccucggccucccaaagugcugggauuacaggcgugagccaccaugccugcccagcaauaccaaccauugucuuuuaaauucguguuggcuucucagacagggagaucacuggaauaaaauaaccgauggucuuauuuugucacacguaaaucaaaagaaauguccucuuugaaguuguaagacuccaccaaugacagacacccuuuucgguggacucugagugguguguagugguuuuauagccauggaaacuaggaguaucucacuuuccacugagaaccccugcccccaaucccucuaaguugggguguggcaguugggcagggucaagugacccagcccuggcuguaggacagccauauacagugaagaguucuagaaccagcuaaaaauggaaguuuggguguuuaccaacaagguaccucuuuauggaugcagccccaguaagcuggcuuuaacucucagcuccuucccugucuccuccuaauccaagcccuuuuauaaaauaaagccccuucugucccacugcucacauacuuaugugcugcuagucucuacucgaaguucgugcaggacuaaugcuuuuaaaaugaggucuaaaaaauaauuacuagucgagacuauuauucuuuaaacagaacugccuuuuucuacucuuuauguaaacucuuucuauuguguuggucuaacaaggcacuauuuuaaaauuuuuuaauuuuucccauagcacuuaaaagagauuuuguaaagaccuugcuguaaagauuuuguaauaaaauggucuaagggcucuuuuuccaacauuaccauuuuuaaaaaauguuuuaaaagcuagaagacaacuuauguauauucuguauauguauagcagcacauuucauuuauggaaauauguucucagaauauuuauuuacuaauauauuuaucuuaagccaugucuuauguugagagugugacauuguuggaauaaucauugaaaaugacuaacacaagacccuguaaauacaugauaauugcacacagauuuuacauauuugcagaccaaaaaugauuuaaaacaaguuguagucuucuaugguuuuguaacaaauuguacacaugacuguaaaaaaaaaauacaauuuuaucaaguauguguu

SEQ ID NO: 8 - DNA, 6851 bp, homo sapien
agaugaaagggccgcggcgcgacggccgggggagccgagcugagccugcgacccacaaagccgccgccgccgccgccgugauggggcugugaggcguccgcccgcguucgguccucagccggcccgcgacuaugcccggccgcgcccgcccuccgcgcccucccgccgcaggaccaugaggccgcgcucgggcgggcgcccaggggccacgggccgccgccgccgccgccugcgccgccgcccccgcggccuccggugcagccgccugccgccgccgccgccgcugccgcugcugcucgggcugcugcuggcggccgcggggcccggcgcggcgcgggccaaggagacggcguucguggagguggugcuguucgagucgagcccaagcggcgauuacaccaccuacaccaccggccucacgggccgcuucucgcgggccggggccacgcucagcgccgagggcgagaucgugcagaugcacccacugggccuauguaauaacaaugacgaagaggacuuguaugaauauggcuggguaggaguggugaagcuggaacagccagaauuggacccgaaaccaugccucacuguccuaggcaaggccaagcgagcaguacagcggggagcuacugcagucaucuuugaugugucugaaaacccagaagcuauugaucagcugaaccagggcucugaagacccgcucaagaggccggugguguaugugaagggugcagaugccauuaagcugaugaacaucgucaacaagcagaaaguggcucgagcaaggauccagcaccgcccuccucgacaacccacugaauacuuugacauggggauuuuccuggcuuucuucgucguggucuccuuggucugccucauccuccuugucaaaaucaagcugaagcagcgacgcagucagaauuccaugaacaggcuggcugugcaggcucuagagaagauggaaaccagaaaguucaacuccaagagcaaggggcgccgggaggggagcuguggggcccuggacacacucagcagcagcuccacguccgacugugccaucugucuggagaaguacauugauggagaggagcugcgggucauccccuguacucaccgguuucacaggaagugcguggaccccuggcugcugcagcaccacaccugcccccacugucggcacaacaucauagaacaaaagggaaacccaagcgcgguguguguggagaccagcaaccucucacguggucggcagcagagggugacccugccggugcauuaccccggccgcgugcacaggaccaacgccaucccagccuacccuacgaggacaagcauggacucccacggcaaccccgucaccuugcugaccauggaccggcacggggagcagagccucuauuccccgcagacccccgccuacauccgcagcuacccaccccuccaccuggaccacagccuggccgcucaccgcugcggccuggagcaccgggccuacuccccagcccaccccuuccgcaggcccaaguugaguggccgcagcuucuccaaggcagcuugcuucucccaguaugagaccauguaccagcacuacuacuuccagggccucagcuacccggagcaggaggggcaguccccaccuagccucgcaccccggggcccggcccgugccuuuccuccgagcggcaguggcagccugcucuuccccaccguggugcacguggccccgcccucccaccuggagagcggcagcacguccagcuucagcugcuaucacggccaccgcucggugugcaguggcuaccuggccgacugcccaggcagcgacagcagcagcagcagcagcuccggccagugccacuguuccuccagugacucugugguagacugcacugaggucagcaaccagggcguguacgggagcugcuccaccuuccgcagcucccucagcagcgacuaugaccccuucaucuaccgcagccggagccccugucgugccagugaggcggggggcucgggcagcucgggccggggaccugcccugugcuucgagggcuccccgccucccgaggagcucccggcggugcgcagucauggugcugggcggggcgagccuuggccgggcccugccucucccucgggggaucagguguccaccugcagccuggagaugaacuacagcagcaacuccucccuggagcacagggggcccaauagcucuaccucagaaguggggcucgaggcuucuccuggggccgccccugaccucaggaggaccuggaaggggggccacgaguugccgucgugugccugcugcugcgagccccagcccuccccagccgggccuagcgccggagcagcuggcagcagcaccuuguuccuggggccccaccucuacgagggcucuggcccggcggguggggagccccagucaggaagcucccagggcuuguacggccuucaccccgaccauuugcccaggacagauggggugaaauacgagggucugcccugcugcuucuaugaagagaagcagguggcccgcgggggcggagggggcagcggcugcuacacugaggacuacucggugagugugcaguacacgcucaccgaggaaccaccgcccggcugcuaccccggggcccgggaccugagccagcgcauccccaucauuccagaggauguggacugugaucugggccugcccucggacugccaagggacccacagccucggcuccuggggugggacgcgaggcccggauaccccacggccccacaggggccugggagcaacccgggaagaggagcgggcucugugcugccaggcuagggcccuacugcggccuggcugcccuccggaggaggcgggugcugucagggccaacuucccuagugcccuccaggacacucaggaguccagcaccacugccacugaggcugcaggaccgagaucucacucagcagacagcagcagcccgggagccugagcucaggaggaacucuuaccuggaaauugggaacuguauggagacuccaaacugacuucuuucaaaaaacaaaaacaaaaaauuuuuuuagcuuugacaaacacacaaaagugguaauaaagagagcccuccuugucaacccaaaaugugagcccccuguggcaaaaccacccccuaccccauuaacaaaucaacagacaaaauucuccgaguccuuugccucuuuugauaacauguuguucuguuuuguaaagugugugugcuugggguuccgaggugugggauugaguucucugcuuuguuuuuuuuuaagauauuguauguaaauguaaaaaguuauuuaaauauauauuuuaaagaacccuaacugccaacuuuugcugaaaaagaaaaaaaaaucacugcugcauuaaaugaaccacaucauguguagauacuguugucucccugaagggagcucaggccuuugaaaagcucagggcuucaccugccuuagaaaaugaaccagaaacuugaaguaaagcuaguugauagggguacaggcucugaggagcagugcaaaacugccucuuucuuucucguggcaaaucccaauguacacgauuucaggucucagacgccaugccucuccagcccacgccuuuaggcaggugauggcagcagcuaggaauaggguguacaugauccacagcccugcggagccaggucaagccgcugcuaugaaagcuccagggugauggggacgauucugcccaguguccucagucuguccccucaggucauggucccaagugaaaugacagaguucacagcccuggucuuggcugagguccaggucauaguaagggcauguucuuggggcccucgaccugaacucugacccuccgggcagggaagaggagguuguccccuuugguuguccuggcuuuggaguccuuugcaaaaauauuuugggcccccugccacuggcugcagaaauggcucgacgggguguguggggacagacacccagaaggaauguacuuuuguggccuugguguccgauggggcugggggagagugcucuccacugacccagcagcacacccaugugcagugcgccugcaucugugugggggcagccacaccccuuggcugcugcuuccuugggcugccuuucugggggcaugugacuggaccuacgaggucugcacugagcuccauuugaaugauaccuuuccuaucccauuucccccacggaagcaccgcuucaggguuauucaguccucugccucauggcugaaauugcucaucucgucugcagaugucuacuauccugucuaccuaaugcacuauuauguauugauucuccaugagacagagagagagagagacuaucagauaguuuacacccaaaggguagguuuuuguauauuuuuccagccuuuuuuauuaaggggaaggggagaguuuaaaaacccaaaccguugugguuuuaagguguuucauuuuuaaaagggagagagaaucuauuuaaagcuauuucagaucagggauugucauccuuuuuuguccaauguauuccuuguucuuuaaaaaaauuuuuuuuagaggaaacuaauauuagucuuuguguucacuaacucuucuggucacuuguauuuauuuauucauucauucaucagauauuuguugccaucugaaagaacuggcccagugggucugaaagcucgcuugagaauaggaaacuugagaccuggcccccuguggguaggagaacaaggaccaccuggguucuccagucuugaacgagaaucucacucuuaucagaauguuuuucuuaaccucagcguaugaugaggaaauuuacuuaucucuagcuaggauuugacaaauuccaacaucaaaugaucaaaacauuugccacugaggcuucacuggugagauccguucuccguccucgggugcagucccuugggggcugcuccucggacugcgccccgcacaccuguuaucgagggugugagaagcgccuaagcuggugacaugugaucugggacgccuucauuucucgggccaggaguagcagcugcuaaggacagcagcuugcauugcgugguuuuagggaagcagggucuggcuuuuaauaugaacugcaaaaagcagcuucucacugauauuuuuuuguuguuguuucugggggguuuuuuuguuuuguuuuuaaugccuuugagugcauauuuucuuccucgucugaaaccgaacucccaaaguggcuuucuuuagcccuggcuggaaaaccaccucucaauagccuuaagcaauaaauagaugaguagagaauguggcuucaacugggcuuauuaaaguaagugugucuaguuuucacuugaacaagugauagcugcagauggcgaaagaaacccauuuaauuuuuguagcuuacaggugguagaaacaaaaaugcaauuuuaaaaccuuaaauaccaaauaccaaccauugccuuuuuuuuuuuugagauggaauuuugcucuugucacccaggcuggagugcaauggcgcgaucucaccucacugcaaccucugccucccggguccaagugauucuccugccucagccucccaaguagcugggauuacaggcaugcgccaccacacccagcuaauuuuguauuuuugguagagacaggguaucuccauguuggucaggcuggucuuggauucccgaccucaggugauccgcccaccucggccucccaaagugcugggauuacaggcgugagccaccaugccugcccagcaauaccaaccauugucuuuuaaauucguguuggcuucucagacagggagaucacuggaauaaaauaaccgauggucuuauuuugucacacguaaaucaaaagaaauguccucuuugaaguuguaagacuccaccaaugacagacacccuuuucgguggacucugagugguguguagugguuuuauagccauggaaacuaggaguaucucacuuuccacugagaaccccugcccccaaucccucuaaguugggguguggcaguugggcagggucaagugacccagcccuggcuguaggacagccauauacagugaagaguucuagaaccagcuaaaaauggaaguuuggguguuuaccaacaagguaccucuuuauggaugcagccccaguaagcuggcuuuaacucucagcuccuucccugucuccuccuaauccaagcccuuuuauaaaauaaagccccuucugucccacugcucacauacuuaugugcugcuagucucuacucgaaguucgugcaggacuaaugcuuuuaaaaugaggucuaaaaaauaauuacuagucgagacuauuauucuuuaaacagaacugccuuuuucuacucuuuauguaaacucuuucuauuguguuggucuaacaaggcacuauuuuaaaauuuuuuaauuuuucccauagcacuuaaaagagauuuuguaaagaccuugcuguaaagauuuuguaauaaaauggucuaagggcucuuuuuccaacauuaccauuuuuaaaaaauguuuuaaaagcuagaagacaacuuauguauauucuguauauguauagcagcacauuucauuuauggaaauauguucucagaauauuuauuuacuaauauauuuaucuuaagccaugucuuauguugagagugugacauuguuggaauaaucauugaaaaugacuaacacaagacccuguaaauacaugauaauugcacacagauuuuacauauuugcagaccaaaaaugauuuaaaacaaguuguagucuucuaugguuuuguaacaaauuguacacaugacuguaaaaaaaaaauacaauuuuaucaaguauguguu

SEQ ID NO: 9 - DNA, 6542 bp, homo sapien
gcggccgcggggcccggcgcggcgcgggccaaggagacggcguucguggagguggugcuguucgagucgagcccaagcggcgauuacaccaccuacaccaccggccucacgggccgcuucucgcgggccggggccacgcucagcgccgagggcgagaucgugcagaugcacccacugggccuauguaauaacaaugacgaagaggacuuguaugaauauggcuggguaggaguggugaagcuggaacagccagaauuggacccgaaaccaugccucacuguccuaggcaaggccaagcgagcaguacagcggggagcuacugcagucaucuuugaugugucugaaaacccagaagcuauugaucagcugaaccagggcucugaagacccgcucaagaggccggugguguaugugaagggugcagaugccauuaagcugaugaacaucgucaacaagcagaaaguggcucgagcaaggauccagcaccgcccuccucgacaacccacugaauacuuugacauggggauuuuccuggcuuucuucgucguggucuccuuggucugccucauccuccuugucaaaaucaagcugaagcagcgacgcagucagaauuccaugaacaggcuggcugugcaggcucuagagaagauggaaaccagaaaguucaacuccaagagcaaggggcgccgggaggggagcuguggggcccuggacacacucagcagcagcuccacguccgacugugccaucugucuggagaaguacauugauggagaggagcugcgggucauccccuguacucaccgguuucacaggaagugcguggaccccuggcugcugcagcaccacaccugcccccacugucggcacaacaucauagaacaaaagggaaacccaagcgcgguguguguggagaccagcaaccucucacguggucggcagcagagggugacccugccggugcauuaccccggccgcgugcacaggaccaacgccaucccagccuacccuacgaggacaagcauggacucccacggcaaccccgucaccuugcugaccauggaccggcacggggagcagagccucuauuccccgcagacccccgccuacauccgcagcuacccaccccuccaccuggaccacagccuggccgcucaccgcugcggccuggagcaccgggccuacuccccagcccaccccuuccgcaggcccaaguugaguggccgcagcuucuccaaggcagcuugcuucucccaguaugagaccauguaccagcacuacuacuuccagggccucagcuacccggagcaggaggggcaguccccaccuagccucgcaccccggggcccggcccgugccuuuccuccgagcggcaguggcagccugcucuuccccaccguggugcacguggccccgcccucccaccuggagagcggcagcacguccagcuucagcugcuaucacggccaccgcucggugugcaguggcuaccuggccgacugcccaggcagcgacagcagcagcagcagcagcuccggccagugccacuguuccuccagugacucugugguagacugcacugaggucagcaaccagggcguguacgggagcugcuccaccuuccgcagcucccucagcagcgacuaugaccccuucaucuaccgcagccggagccccugucgugccagugaggcggggggcucgggcagcucgggccggggaccugcccugugcuucgagggcuccccgccucccgaggagcucccggcggugcgcagucauggugcugggcggggcgagccuuggccgggcccugccucucccucgggggaucagguguccaccugcagccuggagaugaacuacagcagcaacuccucccuggagcacagggggcccaauagcucuaccucagaaguggggcucgaggcuucuccuggggccgccccugaccucaggaggaccuggaaggggggccacgaguugccgucgugugccugcugcugcgagccccagcccuccccagccgggccuagcgccggagcagcuggcagcagcaccuuguuccuggggccccaccucuacgagggcucuggcccggcggguggggagccccagucaggaagcucccagggcuuguacggccuucaccccgaccauuugcccaggacagauggggugaaauacgagggucugcccugcugcuucuaugaagagaagcagguggcccgcgggggcggagggggcagcggcugcuacacugaggacuacucggugagugugcaguacacgcucaccgaggaacccccgcccggcugcuaccccggggcccgggaccugagccagcgcauccccaucauuccagaggauguggacugugaucugggccugcccucggacugccaagggacccacagccucggcuccuggggugggacgcgaggcccggauaccccacggccccacaggggccugggagcaacccgggaagaggagcgggcucugugcugccaggcuagggcccuacugcggccuggcugcccuccggaggaggcgggugcugucagggccaacuucccuagugcccuccaggacacucaggaguccagcaccacugccacugaggcugcaggaccgagaucucacucagcagacagcagcagcccgggagccugagcucaggaggaacucuuaccuggaaauugggaacuguauggagacuccaaacugacuucuuucaaaaaacaaaaacaaaaaauuuuuuuagcuuugacaaacacacaaaagugguaauaaagagagcccuccuugucaacccaaaaugugagcccccuguggcaaaaccacccccuaccccauuaacaaaucaacagacaaaauucuccgaguccuuugccucuuuugauaacauguuguucuguuuuguaaagugugugugcuugggguuccgaggugugggauugaguucucugcuuuguuuuuuuuuaagauauuguauguaaauguaaaaaguuauuuaaauauauauuuuaaagaacccuaacugccaacuuuugcugaaaaagaaaaaaaaaaucacugcugcauuaaaugaaccacaucauguguagauacuguugucucccugaagggagcucaggccuuugaaaagcucagggcuucaccugccuuagaaaaugaaccagaaacuugaaguaaagcuaguugauagggguacaggcucugaggagcagugcaaaacugccucuuucuuucucguggcaaaucccaauguacacgauuucaggucucagacgccaugccucuccagcccacgccuuuaggcaggugauggcagcagcuaggaauaggguguacaugauccacagcccugcggagccaggucaagccgcugcuaugaaagcuccagggugauggggacgauucugcccaguguccucagucuguccccucaggucauggucccaagugaaaugacagaguucacagcccuggucuuggcugagguccaggucauaguaagggcauguucuuggggcccucgaccugaacucugacccuccgggcagggaagaggagguuguccccuuugguuguccuggcuuuggaguccuuugcaaaaauauuuugggcccccugccacuggcugcagaaauggcucgacgggguguguggggacagacacccagaaggaauguacuuuuguggccuugguguccgauggggcugggggagagugcucuccacugacccagcagcacacccaugugcagugcgccugcaucugugugggggcagccacaccccuuggcugcugcuuccuugggcugccuuucugggggcaugugacuggaccuacgaggucugcacugagcuccauuugaaugauaccuuuccuaucccauuucccccacggaagcaccgcuucaggguuauucaguccucugccucauggcugaaauugcucaucucgucugcagaugucuacuauccugucuaccuaaugcacuauuauguauugauucuccaugagacagagagagagagagacuaucagauaguuuacacccaaaggguagguuuuuguauauuuuuccagccuuuuuuauuaaggggaaggggagaguuuaaaaacccaaaccguugugguuuuaagguguuucauuuuuaaaagggagagagaaucuauuuaaagcuauuucagaucagggauugucauccuuuuuuguccaauguauuccuuguucuuuaaaaaaauuuuuuuuagaggaaacuaauauuagucuuuguguucacuaacucuucuggucacuuguauuuauuuauucauucauucaucagauauuuguugccaucugaaagaacuggcccagugggucugaaagcucgcuugagaauaggaaacuugagaccuggcccccuguggguaggagaacaaggaccaccuggguucuccagucuugaacgagaaucucacucuuaucagaauguuuuucuuaaccucagcguaugaugaggaaauuuacuuaucucuagcuaggauuugacaaauuccaacaucaaaugaucaaaacauuugccacugaggcuucacuggugagauccguucuccguccucgggugcagucccuugggggcugcuccucggacugcgccccgcacaccuguuaucgagggugugagaagcgccuaagcuggugacaugugaucugggacgccuucauuucucgggccaggaguagcagcugcuaaggacagcagcuugcauugcgugguuuuagggaagcagggucuggcuuuuaauaugaacugcaaaaagcagcuucucacugauauuuuuuuguuguuguuucugggggguuuuuuuguuuuguuuuuaaugccuuugagugcauauuuucuuccucgucugaaaccgaacucccaaaguggcuuucuuuagcccuggcuggaaaaccaccucucaauagccuuaagcaauaaauagaugaguagagaauguggcuucaacugggcuuauuaaaguaagugugucuaguuuucacuugaacaagugauagcugcagauggcgaaagaaacccauuuaauuuuuguagcuuacaggugguagaaacaaaaaugcaauuuuaaaaccuuaaauaccaaauaccaaccauugccuuuuuuuuuuuugagauggaauuuugcucuugucacccaggcuggagugcaauggcgcgaucucaccucacugcaaccucugccucccggguccaagugauucuccugccucagccucccaaguagcugggauuacaggcaugcgccaccacacccagcuaauuuuguauuuuugguagagacaggguaucuccauguuggucaggcuggucuuggauucccgaccucaggugauccgcccaccucggccucccaaagugcugggauuacaggcgugagccaccaugccugcccagcaauaccaaccauugucuuuuaaauucguguuggcuucucagacagggagaucacuggaauaaaauaaccgauggucuuauuuugucacacguaaaucaaaagaaauguccucuuugaaguuguaagacuccaccaaugacagacacccuuuucgguggacucugagugguguguagugguuuuauagccauggaaacuaggaguaucucacuuuccacugagaaccccugcccccaaucccucuaaguugggguguggcaguugggcagggucaagugacccagcccuggcuguaggacagccauauacagugaagaguucuagaaccagcuaaaaauggaaguuuggguguuuaccaacaagguaccucuuuauggaugcagccccaguaagcuggcuuuaacucucagcuccuucccugucuccuccuaauccaagcccuuuuauaaaauaaagccccuucugucccacugcucacauacuuaugugcugcuagucucuacucgaaguucgugcaggacuaaugcuuuuaaaaugaggucuaaaaaauaauuacuagucgagacuauuauucuuuaaacagaacugccuuuuucuacucuuuauguaaacucuuucuauuguguuggucuaacaaggcacuauuuuaaaauuuuuuaauuuuucccauagcacuuaaaagagauuuuguaaagaccuugcuguaaagauuuuguaauaaaauggucuaagggcucuuuuuccaacauuaccauuuuuaaaaaauguuuuaaaagcuagaagacaacuuauguauauucuguauauguauagcagcacauuucauuuauggaaauauguucucagaauauuuauuuacuaauauauuuaucuuaagccaugucuuauguugagagugugacauuguuggaauaaucauugaaaaugacuaacacaagacccuguaaauacaugauaauugcacacagauuuuacauauuugcagaccaaaaaugauuuaaaacaaguuguagucuucuaugguuuuguaacaaauuguacacaugacuguaaaaaaaaaauacaauuuuaucaaguauguguu

SEQ ID NO: 10 - DNA, 6851 bp, homo sapien
agatgaaagggccgcggcgcgacggccgggggagccgagctgagcctgcgacccacaaagccgccgccgccgccgccgtgatggggctgtgaggcgtccgcccgcgttcggtcctcagccggcccgcgactatgcccggccgcgcccgccctccgcgccctcccgccgcaggaccatgaggccgcgctcgggcgggcgcccaggggccacgggccgccgccgccgccgcctgcgccgccgcccccgcggcctccggtgcagccgcctgccgccgccgccgccgctgccgctgctgctcgggctgctgctggcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgtt

SEQ ID NO: 11 - DNA, 6542 bp, homo sapien
gcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaacccccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgtt

SEQ ID NO: 12 - DNA, 6850 bp, homo sapien
agatgaaagggccgcggcgcgacggccgggggagccgagctgagcctgcgacccacaaagccgccgccgccgccgccgtgatggggctgtgaggcgtccgcccgcgttcggtcctcagccggcccgcgactatgcccggccgcgcccgccctccgcgccctcccgccgcaggaccatgaggccgcgctcgggcgggcgcccaggggccacgggccgccgccgccgccgcctgcgccgccgcccccgcggcctccggtgcagccgcctgccgccgccgccgccgctgccgctgctgctcgggctgctgctggcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcgactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgtt

SEQ ID NO: 13 - DNA, 6541 bp, homo sapien
gcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaacccccgcccggctgctaccccggggcccgggacctgagccagcgcatccccatcattccagaggatgtggactgtgatctgggcctgccctcgactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgtt

SEQ ID NO: 14 - DNA, 6851 bp, homo sapien
agatgaaagggccgcggcgcgacggccgggggagccgagctgagcctgcgacccacaaagccgccgccgccgccgccgtgatggggctgtgaggcgtccgcccgcgttcggtcctcagccggcccgcgactatgcccggccgcgcccgccctccgcgccctcccgccgcaggaccatgaggccgcgctcgggcgggcgcccaggggccacgggccgccgccgccgccgcctgcgccgccgcccccgcggcctccggtgcagccgcctgccgccgccgccgccgctgccgctgctgctcgggctgctgctggcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcgcagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaaccaccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgtt

SEQ ID NO: 15 - DNA, 6542 bp, homo sapien
gcggccgcggggcccggcgcggcgcgggccaaggagacggcgttcgtggaggtggtgctgttcgagtcgagcccaagcggcgattacaccacctacaccaccggcctcacgggccgcttctcgcgggccggggccacgctcagcgccgagggcgagatcgtgcagatgcacccactgggcctatgtaataacaatgacgaagaggacttgtatgaatatggctgggtaggagtggtgaagctggaacagccagaattggacccgaaaccatgcctcactgtcctaggcaaggccaagcgagcagtacagcggggagctactgcagtcatctttgatgtgtctgaaaacccagaagctattgatcagctgaaccagggctctgaagacccgctcaagaggccggtggtgtatgtgaagggtgcagatgccattaagctgatgaacatcgtcaacaagcagaaagtggctcgagcaaggatccagcaccgccctcctcgacaacccactgaatactttgacatggggattttcctggctttcttcgtcgtggtctccttggtctgcctcatcctccttgtcaaaatcaagctgaagcagcgacgcagtcagaattccatgaacaggctggctgtgcaggctctagagaagatggaaaccagaaagttcaactccaagagcaaggggcgccgggaggggagctgtggggccctggacacactcagcagcagctccacgtccgactgtgccatctgtctggagaagtacattgatggagaggagctgcgggtcatcccctgtactcaccggtttcacaggaagtgcgtggacccctggctgctgcagcaccacacctgcccccactgtcggcacaacatcatagaacaaaagggaaacccaagcgcggtgtgtgtggagaccagcaacctctcacgtggtcggcagcagagggtgaccctgccggtgcattaccccggccgcgtgcacaggaccaacgccatcccagcctaccctacgaggacaagcatggactcccacggcaaccccgtcaccttgctgaccatggaccggcacggggagcagagcctctattccccgcagacccccgcctacatccgcagctacccacccctccacctggaccacagcctggccgctcaccgctgcggcctggagcaccgggcctactccccagcccaccccttccgcaggcccaagttgagtggccgcagcttctccaaggcagcttgcttctcccagtatgagaccatgtaccagcactactacttccagggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcgcagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctccccagccgggcctagcgccggagcagctggcagcagcaccttgttcctggggccccacctctacgagggctctggcccggcgggtggggagccccagtcaggaagctcccagggcttgtacggccttcaccccgaccatttgcccaggacagatggggtgaaatacgagggtctgccctgctgcttctatgaagagaagcaggtggcccgcgggggcggagggggcagcggctgctacactgaggactactcggtgagtgtgcagtacacgctcaccgaggaacccccgcccggctgctaccccggggcccgggacctgagccagcgcatccccatcattccagaggatgtggactgtgatctgggcctgccctcggactgccaagggacccacagcctcggctcctggggtgggacgcgaggcccggataccccacggccccacaggggcctgggagcaacccgggaagaggagcgggctctgtgctgccaggctagggccctactgcggcctggctgccctccggaggaggcgggtgctgtcagggccaacttccctagtgccctccaggacactcaggagtccagcaccactgccactgaggctgcaggaccgagatctcactcagcagacagcagcagcccgggagcctgagctcaggaggaactcttacctggaaattgggaactgtatggagactccaaactgacttctttcaaaaaacaaaaacaaaaaatttttttagctttgacaaacacacaaaagtggtaataaagagagccctccttgtcaacccaaaatgtgagccccctgtggcaaaaccaccccctaccccattaacaaatcaacagacaaaattctccgagtcctttgcctcttttgataacatgttgttctgttttgtaaagtgtgtgtgcttggggttccgaggtgtgggattgagttctctgctttgtttttttttaagatattgtatgtaaatgtaaaaagttatttaaatatatattttaaagaaccctaactgccaacttttgctgaaaaagaaaaaaaaaatcactgctgcattaaatgaaccacatcatgtgtagatactgttgtctccctgaagggagctcaggcctttgaaaagctcagggcttcacctgccttagaaaatgaaccagaaacttgaagtaaagctagttgataggggtacaggctctgaggagcagtgcaaaactgcctctttctttctcgtggcaaatcccaatgtacacgatttcaggtctcagacgccatgcctctccagcccacgcctttaggcaggtgatggcagcagctaggaatagggtgtacatgatccacagccctgcggagccaggtcaagccgctgctatgaaagctccagggtgatggggacgattctgcccagtgtcctcagtctgtcccctcaggtcatggtcccaagtgaaatgacagagttcacagccctggtcttggctgaggtccaggtcatagtaagggcatgttcttggggccctcgacctgaactctgaccctccgggcagggaagaggaggttgtcccctttggttgtcctggctttggagtcctttgcaaaaatattttgggccccctgccactggctgcagaaatggctcgacggggtgtgtggggacagacacccagaaggaatgtacttttgtggccttggtgtccgatggggctgggggagagtgctctccactgacccagcagcacacccatgtgcagtgcgcctgcatctgtgtgggggcagccacaccccttggctgctgcttccttgggctgcctttctgggggcatgtgactggacctacgaggtctgcactgagctccatttgaatgatacctttcctatcccatttcccccacggaagcaccgcttcagggttattcagtcctctgcctcatggctgaaattgctcatctcgtctgcagatgtctactatcctgtctacctaatgcactattatgtattgattctccatgagacagagagagagagagactatcagatagtttacacccaaagggtaggtttttgtatatttttccagccttttttattaaggggaaggggagagtttaaaaacccaaaccgttgtggttttaaggtgtttcatttttaaaagggagagagaatctatttaaagctatttcagatcagggattgtcatccttttttgtccaatgtattccttgttctttaaaaaaattttttttagaggaaactaatattagtctttgtgttcactaactcttctggtcacttgtatttatttattcattcattcatcagatatttgttgccatctgaaagaactggcccagtgggtctgaaagctcgcttgagaataggaaacttgagacctggccccctgtgggtaggagaacaaggaccacctgggttctccagtcttgaacgagaatctcactcttatcagaatgtttttcttaacctcagcgtatgatgaggaaatttacttatctctagctaggatttgacaaattccaacatcaaatgatcaaaacatttgccactgaggcttcactggtgagatccgttctccgtcctcgggtgcagtcccttgggggctgctcctcggactgcgccccgcacacctgttatcgagggtgtgagaagcgcctaagctggtgacatgtgatctgggacgccttcatttctcgggccaggagtagcagctgctaaggacagcagcttgcattgcgtggttttagggaagcagggtctggcttttaatatgaactgcaaaaagcagcttctcactgatatttttttgttgttgtttctggggggtttttttgttttgtttttaatgcctttgagtgcatattttcttcctcgtctgaaaccgaactcccaaagtggctttctttagccctggctggaaaaccacctctcaatagccttaagcaataaatagatgagtagagaatgtggcttcaactgggcttattaaagtaagtgtgtctagttttcacttgaacaagtgatagctgcagatggcgaaagaaacccatttaatttttgtagcttacaggtggtagaaacaaaaatgcaattttaaaaccttaaataccaaataccaaccattgccttttttttttttgagatggaattttgctcttgtcacccaggctggagtgcaatggcgcgatctcacctcactgcaacctctgcctcccgggtccaagtgattctcctgcctcagcctcccaagtagctgggattacaggcatgcgccaccacacccagctaattttgtatttttggtagagacagggtatctccatgttggtcaggctggtcttggattcccgacctcaggtgatccgcccacctcggcctcccaaagtgctgggattacaggcgtgagccaccatgcctgcccagcaataccaaccattgtcttttaaattcgtgttggcttctcagacagggagatcactggaataaaataaccgatggtcttattttgtcacacgtaaatcaaaagaaatgtcctctttgaagttgtaagactccaccaatgacagacacccttttcggtggactctgagtggtgtgtagtggttttatagccatggaaactaggagtatctcactttccactgagaacccctgcccccaatccctctaagttggggtgtggcagttgggcagggtcaagtgacccagccctggctgtaggacagccatatacagtgaagagttctagaaccagctaaaaatggaagtttgggtgtttaccaacaaggtacctctttatggatgcagccccagtaagctggctttaactctcagctccttccctgtctcctcctaatccaagcccttttataaaataaagccccttctgtcccactgctcacatacttatgtgctgctagtctctactcgaagttcgtgcaggactaatgcttttaaaatgaggtctaaaaaataattactagtcgagactattattctttaaacagaactgcctttttctactctttatgtaaactctttctattgtgttggtctaacaaggcactattttaaaattttttaatttttcccatagcacttaaaagagattttgtaaagaccttgctgtaaagattttgtaataaaatggtctaagggctctttttccaacattaccatttttaaaaaatgttttaaaagctagaagacaacttatgtatattctgtatatgtatagcagcacatttcatttatggaaatatgttctcagaatatttatttactaatatatttatcttaagccatgtcttatgttgagagtgtgacattgttggaataatcattgaaaatgactaacacaagaccctgtaaatacatgataattgcacacagattttacatatttgcagaccaaaaatgatttaaaacaagttgtagtcttctatggttttgtaacaaattgtacacatgactgtaaaaaaaaaatacaattttatcaagtatgtgtt

SEQ ID NO: 16 - protein, 936 aa, homo sapien
MRPRSGGRPGATGRRRRRLRRRPRGLRCSRLPPPPPLPLLLGLLLAAAGPGAARAKETAFVEVVLFESSPSGDYTTYTTGLTGRFSRAGATLSAEGEIVQMHPLGLCNNNDEEDLYEYGWVGVVKLEQPELDPKPCLTVLGKAKRAVQRGATAVIFDVSENPEAIDQLNQGSEDPLKRPVVYVKGADAIKLMNIVNKQKVARARIQHRPPRQPTEYFDMGIFLAFFVVVSLVCLILLVKIKLKQRRSQNSMNRLAVQALEKMETRKFNSKSKGRREGSCGALDTLSSSSTSDCAICLEKYIDGEELRVIPCTHRFHRKCVDPWLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLDHSLAAHRCGLEHRAYSPAHPFRRPKLSGRSFSKAACFSQYETMYQHYYFQGLSYPEQEGQSPPSLAPRGPARAFPPSGSGSLLFPTVVHVAPPSHLESGSTSSFSCYHGHRSVCSGYLADCPGSDSSSSSSSGQCHCSSSDSVVDCTEVSNQGVYGSCSTFRSSLSSDYDPFIYRSRSPCRASEAGGSGSSGRGPALCFEGSPPPEELPAVHSHGAGRGEPWPGPASPSGDQVSTCSLEMNYSSNSSLEHRGPNSSTSEVGLEASPGAAPDLRRTWKGGHELPSCACCCEPQPSPAGPSAGAAGSSTLFLGPHLYEGSGPAGGEPQSGSSQGLYGLHPDHLPRTDGVKYEGLPCCFYEEKQVARGGGGGSGCYTEDYSVSVQYTLTEEPPPGCYPGARDLSQRIPIIPEDVDCDLGLPSDCQGTHSLGSWGGTRGPDTPRPHRGLGATREEERALCCQARALLRPGCPPEEAGAVRANFPSALQDTQESSTTATEAAGPRSHSADSSSPGA

SEQ ID NO: 17 - protein, 836 aa, homo sapien
MHPLGLCNNNDEEDLYEYGWVGVVKLEQPELDPKPCLTVLGKAKRAVQRGATAVIFDVSENPEAIDQLNQGSEDPLKRPVVYVKGADAIKLMNIVNKQKVARARIQHRPPRQPTEYFDMGIFLAFFVVVSLVCLILLVKIKLKQRRSQNSMNRLAVQALEKMETRKFNSKSKGRREGSCGALDTLSSSSTSDCAICLEKYIDGEELRVIPCTHRFHRKCVDPWLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLDHSLAAHRCGLEHRAYSPAHPFRRPKLSGRSFSKAACFSQYETMYQHYYFQGLSYPEQEGQSPPSLAPRGPARAFPPSGSGSLLFPTVVHVAPPSHLESGSTSSFSCYHGHRSVCSGYLADCPGSDSSSSSSSGQCHCSSSDSVVDCTEVSNQGVYGSCSTFRSSLSSDYDPFIYRSRSPCRASEAGGSGSSGRGPALCFEGSPPPEELPAVHSHGAGRGEPWPGPASPSGDQVSTCSLEMNYSSNSSLEHRGPNSSTSEVGLEASPGAAPDLRRTWKGGHELPSCACCCEPQPSPAGPSAGAAGSSTLFLGPHLYEGSGPAGGEPQSGSSQGLYGLHPDHLPRTDGVKYEGLPCCFYEEKQVARGGGGGSGCYTEDYSVSVQYTLTEEPPPGCYPGARDLSQRIPIIPEDVDCDLGLPSDCQGTHSLGSWGGTRGPDTPRPHRGLGATREEERALCCQARALLRPGCPPEEAGAVRANFPSALQDTQESSTTATEAAGPRSHSADSSSPGA

SEQ ID NO: 18 - protein, 954 aa, homo sapien
MRPRSGGRPGATGRRRRRLRRRPRGLRCSRLPPPPPLPLLLGLLLAAAGPGAARAKETAFVEVVLFESSPSGDYTTYTTGLTGRFSRAGATLSAEGEIVQMHPLGLCNNNDEEDLYEYGWVGVVKLEQPELDPKPCLTVLGKAKRAVQRGATAVIFDVSENPEAIDQLNQGSEDPLKRPVVYVKGADAIKLMNIVNKQKVARARIQHRPPRQPTEYFDMGIFLAFFVVVSLVCLILLVKIKLKQRRSQNSMNRLAVQALEKMETRKFNSKSKGRREGSCGALDTLSSSSTSDCAICLEKYIDGEELRVIPCTHRFHRKCVDPWLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLDHSLAAHRCGLEHRAYSPAHPFRRPKLSGRSFSKAACFSQYETMYQHYYFQGLSYPEQEGQSPPSLAPRGPARAFPPSGSGSLLFPTVVHVAPPSHLESGSTSSFSCYHGHRSVCSGYLADCPGSDSSSSSSSGQCHCSSSDSVVDCTEVSNQGVYGSCSTFRSSLSSDYDPFIYRSRSPCRASEAGGSGSSGRGPALCFEGSPPPEELPAVHSHGAGRGEPWPGPASPSGDQVSTCSLEMNYSSNSSLEHRGPNSSTSEVGLEASPGAAPDLRRTWKGGHELPSCACCCEPQPSPAGPSAGAAGSSTLFLGPHLYEGSGPAGGEPQSGSSQGLYGLHPDHLPRTDGVKYEGLPCCFYEEKQVARGGGGGSGCYTEDYSVSVQYTLTEEPPPGCYPGARDLSQRIPIIPEDVDCDLGLPSTAKGPTASAPGVGREARIPHGPTGAWEQPGKRSGLCAARLGPYCGLAALRRRRVLSGPTSLVPSRTLRSPAPLPLRLQDRDLTQQTAAAREPELRRNSYLEIGNCMETPN

SEQ ID NO: 19 - protein, 854 aa, homo sapien
MHPLGLCNNNDEEDLYEYGWVGVVKLEQPELDPKPCLTVLGKAKRAVQRGATAVIFDVSENPEAIDQLNQGSEDPLKRPVVYVKGADAIKLMNIVNKQKVARARIQHRPPRQPTEYFDMGIFLAFFVVVSLVCLILLVKIKLKQRRSQNSMNRLAVQALEKMETRKFNSKSKGRREGSCGALDTLSSSSTSDCAICLEKYIDGEELRVIPCTHRFHRKCVDPWLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLDHSLAAHRCGLEHRAYSPAHPFRRPKLSGRSFSKAACFSQYETMYQHYYFQGLSYPEQEGQSPPSLAPRGPARAFPPSGSGSLLFPTVVHVAPPSHLESGSTSSFSCYHGHRSVCSGYLADCPGSDSSSSSSSGQCHCSSSDSVVDCTEVSNQGVYGSCSTFRSSLSSDYDPFIYRSRSPCRASEAGGSGSSGRGPALCFEGSPPPEELPAVHSHGAGRGEPWPGPASPSGDQVSTCSLEMNYSSNSSLEHRGPNSSTSEVGLEASPGAAPDLRRTWKGGHELPSCACCCEPQPSPAGPSAGAAGSSTLFLGPHLYEGSGPAGGEPQSGSSQGLYGLHPDHLPRTDGVKYEGLPCCFYEEKQVARGGGGGSGCYTEDYSVSVQYTLTEEPPPGCYPGARDLSQRIPIIPEDVDCDLGLPSTAKGPTASAPGVGREARIPHGPTGAWEQPGKRSGLCAARLGPYCGLAALRRRRVLSGPTSLVPSRTLRSPAPLPLRLQDRDLTQQTAAAREPELRRNSYLEIGNCMETPN

SEQ ID NO: 20 - protein, 936 aa, homo sapien
MRPRSGGRPGATGRRRRRLRRRPRGLRCSRLPPPPPLPLLLGLLLAAAGPGAARAKETAFVEVVLFESSPSGDYTTYTTGLTGRFSRAGATLSAEGEIVQMHPLGLCNNNDEEDLYEYGWVGVVKLEQPELDPKPCLTVLGKAKRAVQRGATAVIFDVSENPEAIDQLNQGSEDPLKRPVVYVKGADAIKLMNIVNKQKVARARIQHRPPRQPTEYFDMGIFLAFFVVVSLVCLILLVKIKLKQRRSQNSMNRLAVQALEKMETRKFNSKSKGRREGSCGALDTLSSSSTSDCAICLEKYIDGEELRVIPCTHRFHRKCVDPWLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLDHSLAAHRCGLEHRAYSPAHPFRRPKLSGRSFSKAACFSQYETMYQHYYFQGLSYPEQEGQSPPSLAPRGPARAFPPSGSGSLLFPTVVHVAPPSHLESGSTSSFSCYHGHRSVCSGYLADCPGSDSSSSSSSGQCHCSSSDSVVDCTEVSNQGVYGSCSTFRSSLSSDYDPFIYRSRSPCRASEAGGSGSSGRGPALCFEGSPPPEELPAVRSHGAGRGEPWPGPASPSGDQVSTCSLEMNYSSNSSLEHRGPNSSTSEVGLEASPGAAPDLRRTWKGGHELPSCACCCEPQPSPAGPSAGAAGSSTLFLGPHLYEGSGPAGGEPQSGSSQGLYGLHPDHLPRTDGVKYEGLPCCFYEEKQVARGGGGGSGCYTEDYSVSVQYTLTEEPPPGCYPGARDLSQRIPIIPEDVDCDLGLPSDCQGTHSLGSWGGTRGPDTPRPHRGLGATREEERALCCQARALLRPGCPPEEAGAVRANFPSALQDTQESSTTATEAAGPRSHSADSSSPGA

SEQ ID NO: 21 - protein, 836 aa, homo sapien
MHPLGLCNNNDEEDLYEYGWVGVVKLEQPELDPKPCLTVLGKAKRAVQRGATAVIFDVSENPEAIDQLNQGSEDPLKRPVVYVKGADAIKLMNIVNKQKVARARIQHRPPRQPTEYFDMGIFLAFFVVVSLVCLILLVKIKLKQRRSQNSMNRLAVQALEKMETRKFNSKSKGRREGSCGALDTLSSSSTSDCAICLEKYIDGEELRVIPCTHRFHRKCVDPWLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLDHSLAAHRCGLEHRAYSPAHPFRRPKLSGRSFSKAACFSQYETMYQHYYFQGLSYPEQEGQSPPSLAPRGPARAFPPSGSGSLLFPTVVHVAPPSHLESGSTSSFSCYHGHRSVCSGYLADCPGSDSSSSSSSGQCHCSSSDSVVDCTEVSNQGVYGSCSTFRSSLSSDYDPFIYRSRSPCRASEAGGSGSSGRGPALCFEGSPPPEELPAVRSHGAGRGEPWPGPASPSGDQVSTCSLEMNYSSNSSLEHRGPNSSTSEVGLEASPGAAPDLRRTWKGGHELPSCACCCEPQPSPAGPSAGAAGSSTLFLGPHLYEGSGPAGGEPQSGSSQGLYGLHPDHLPRTDGVKYEGLPCCFYEEKQVARGGGGGSGCYTEDYSVSVQYTLTEEPPPGCYPGARDLSQRIPIIPEDVDCDLGLPSDCQGTHSLGSWGGTRGPDTPRPHRGLGATREEERALCCQARALLRPGCPPEEAGAVRANFPSALQDTQESSTTATEAAGPRSHSADSSSPGA

SEQ ID NO: 22 - DNA, 23 bp, homo sapien
gcaccatgactgtgcaccgccgg

SEQ ID NO: 23 - DNA, 23 bp, homo sapien
caccatgactgtgcaccgccggg

SEQ ID NO: 24 - DNA, 23 bp, homo sapien
gcggtgcacagtcatggtgctgg

SEQ ID NO: 25 - DNA, 23 bp, homo sapien
gtgcaccgccgggagctcctcgg

SEQ ID NO: 26 - DNA, 23 bp, homo sapien
cggtgcacagtcatggtgctggg

SEQ ID NO: 27 - DNA, 23 bp, homo sapien
ctcccggcggtgcacagtcatgg

SEQ ID NO: 28 - DNA, 23 bp, homo sapien
gcacagtcatggtgctgggcggg

SEQ ID NO: 29 - DNA, 23 bp, homo sapien
cacagtcatggtgctgggcgggg

SEQ ID NO: 30 - DNA, 23 bp, homo sapien
tgcacagtcatggtgctgggcgg

SEQ ID NO: 31 - DNA, 23 bp, homo sapien
ctccggctgcggtagatgaaggg

SEQ ID NO: 32 - DNA, 23 bp, homo sapien
tgggtcccttggcagtccgaggg

SEQ ID NO: 33 - DNA, 23 bp, homo sapien
gcctgccctcggactgccaaggg

SEQ ID NO: 34 - DNA, 23 bp, homo sapien
tcccttggcagtccgagggcagg

SEQ ID NO: 35 - DNA, 23 bp, homo sapien
gtgggtcccttggcagtccgagg

SEQ ID NO: 36 - DNA, 23 bp, homo sapien
ggcctgccctcggactgccaagg

SEQ ID NO: 37 - DNA, 23 bp, homo sapien
agccgaggctgtgggtcccttgg

SEQ ID NO: 38 - DNA, 23 bp, homo sapien
cgcgaggcccggataccccacgg

SEQ ID NO: 39 - DNA, 23 bp, homo sapien
ctcaccgaggaaccaccgcccgg

What is claimed is:

1. A method of treating a patient with a therapeutic agent that treats or inhibits decreased bone mineral density, wherein the patient is suffering from decreased bone mineral density, the method comprising the steps of:
   determining whether the patient has a Zinc And Ring Finger 3 (ZNRF3) predicted loss-of-function variant nucleic acid molecule encoding a human ZNRF3 polypeptide by:
      obtaining or having obtained a biological sample from the patient; and
      performing or having performed a genotyping assay on the biological sample to determine if the patient has a genotype comprising the ZNRF3 predicted loss-of-function variant nucleic acid molecule; and
   when the patient is ZNRF3 reference, then administering or continuing to administer to the patient the therapeutic agent that treats or inhibits decreased bone mineral density in a standard dosage amount, and administering to the patient a ZNRF3 inhibitor; and
   when the patient is heterozygous for a ZNRF3 predicted loss-of-function variant, then administering or continuing to administer to the patient the therapeutic agent that treats or inhibits decreased bone mineral density in an amount that is the same as or lower than a standard dosage amount, and administering to the patient a ZNRF3 inhibitor;
   wherein the presence of a genotype having the ZNRF3 predicted loss-of-function variant nucleic acid molecule encoding the human ZNRF3 polypeptide indicates the patient has a reduced risk of developing decreased bone mineral density; and
   wherein the ZNRF3 predicted loss-of-function variant is: a genomic nucleic acid molecule having a nucleotide sequence comprising a deletion of the position corresponding to position 167,122 according to SEQ ID NO:1; an mRNA molecule having a nucleotide sequence comprising a deletion of the position corresponding to position 2,707 according to SEQ ID NO:4, or a deletion of the position corresponding to position 2,397 according to SEQ ID NO:5; a cDNA molecule produced from an mRNA molecule in the biological sample, wherein the cDNA molecule has a nucleotide sequence comprising a deletion of the position corresponding to position 2,707 according to SEQ ID NO:10, or a deletion of the position corresponding to positions 2,397 according to SEQ ID NO:11; a genomic nucleic acid molecule having a nucleotide sequence comprising a guanine at a position corresponding to position 166,500 according to SEQ ID NO:3; an mRNA molecule having a nucleotide sequence comprising a guanine at a position corresponding to position 2,085 according to SEQ ID NO:8, or a guanine at a position corresponding to positions 1,175 according to SEQ ID NO:9; or a cDNA molecule produced from an mRNA molecule in the biological sample, wherein the cDNA molecule has a nucleotide sequence comprising a guanine at a position corresponding to position 2,085 according to SEQ ID NO:14, or a guanine at a position corresponding to position 1,175 according to SEQ ID NO:15.

2. The method according to claim 1, wherein the patient has or is suspected of having osteopenia.

3. The method according to claim 1, wherein the patient has or is suspected of having osteoporosis.

4. The method according to claim 1, wherein the ZNRF3 inhibitor comprises an antisense nucleic acid molecule, a small interfering RNA (siRNA), or a short hairpin RNA (shRNA) that hybridizes to a ZNRF3 mRNA.

5. The method according to claim 1, wherein the ZNRF3 inhibitor comprises an antisense nucleic acid molecule that hybridizes to a ZNRF3 mRNA.

6. The method according to claim 1, wherein the ZNRF3 inhibitor comprises an siRNA that hybridizes to a ZNRF3 mRNA.

7. The method according to claim 1, wherein the ZNRF3 inhibitor comprises a Cas protein and guide RNA (gRNA) that hybridizes to a gRNA recognition sequence within a ZNRF3 genomic nucleic acid molecule.

8. The method according to claim 1, wherein determining whether the patient has a ZNRF3 predicted loss-of-function variant nucleic acid molecule comprises detecting the presence or absence of a genomic nucleic acid molecule having a nucleotide sequence comprising a deletion of the position corresponding to position 167,122 according to SEQ ID NO:1.

9. The method according to claim 1, wherein determining whether the patient has a ZNRF3 predicted loss-of-function variant nucleic acid molecule comprises detecting the presence or absence of an mRNA molecule having a nucleotide sequence comprising a deletion of the position corresponding to position 2,707 according to SEQ ID NO:4, or a deletion of the position corresponding to position 2,397 according to SEQ ID NO:5.

10. The method according to claim 1, wherein determining whether the patient has a ZNRF3 predicted loss-of-function variant nucleic acid molecule comprises detecting the presence or absence of a cDNA molecule produced from an mRNA molecule in the biological sample, wherein the cDNA molecule has a nucleotide sequence comprising a deletion of the position corresponding to position 2,707 according to SEQ ID NO:10, or a deletion of the position corresponding to positions 2,397 according to SEQ ID NO:11.

11. The method according to claim 1, wherein determining whether the patient has a ZNRF3 predicted loss-of-function variant nucleic acid molecule comprises detecting the presence or absence of a genomic nucleic acid molecule having a nucleotide sequence comprising a guanine at a position corresponding to position 166,500 according to SEQ ID NO:3.

12. The method according to claim 1, wherein determining whether the patient has a ZNRF3 predicted loss-of-function variant nucleic acid molecule comprises detecting the presence or absence of an mRNA molecule having a nucleotide sequence comprising a guanine at a position corresponding to position 2,085 according to SEQ ID NO:8, or a guanine at a position corresponding to positions 1,175 according to SEQ ID NO:9.

13. The method according to claim 1, wherein determining whether the patient has a ZNRF3 predicted loss-of-function variant nucleic acid molecule comprises detecting the presence or absence of a cDNA molecule produced from an mRNA molecule in the biological sample, wherein the cDNA molecule has a nucleotide sequence comprising a guanine at a position corresponding to position 2,085 according to SEQ ID NO:14, or a guanine at a position corresponding to position 1,175 according to SEQ ID NO:15.

14. The method according to claim 1, wherein the genotyping assay comprises sequencing at least a portion of the nucleotide sequence of the ZNRF3 nucleic acid molecule, wherein the sequenced portion comprises: a position corresponding to position 167,122 according to SEQ ID NO:2, or any position 3' thereto, or the complement thereof; a position corresponding to position 166,500 according to SEQ ID NO:3, or the complement thereof; a position corresponding to position 2,707 according to SEQ ID NO:6, or any position 3' thereto, or the complement thereof; a position corresponding to position 2,397 according to SEQ ID NO:7, or any position 3' thereto, or the complement thereof; a position corresponding to position 2,085 according to SEQ ID NO:8, or the complement thereof; a position corresponding to position 1,775 according to SEQ ID NO:9, or the complement thereof; a position corresponding to position 2,707 according to SEQ ID NO:12, or any position 3' thereto, or the complement thereof; a position corresponding to position 2,397 according to SEQ ID NO:13, or any position 3' thereto, or the complement thereof; a position corresponding to position 2,085 according to SEQ ID NO:14, or the complement thereof; or a position corresponding to position 1,775 according to SEQ ID NO:15, or the complement thereof.

15. The method according to claim 1, wherein the genotyping assay comprises:
  a) contacting the biological sample with a primer hybridizing to a portion of the nucleotide sequence of the ZNRF3 genomic nucleic acid molecule that is proximate to a position corresponding to: position 167,122 according to SEQ ID NO:2; position 166,500 according to SEQ ID NO:3; position 2,707 according to SEQ ID NO:6; position 2,397 according to SEQ ID NO:7; position 2,085 according to SEQ ID NO:8; position 1,775 according to SEQ ID NO:9; position 2,707 according to SEQ ID NO:12; position 2,397 according to SEQ ID NO:13; position 2,085 according to SEQ ID NO:14; or position 1,775 according to SEQ ID NO:15;
  b) extending the primer at least through the position of the nucleotide sequence of the ZNRF3 nucleic acid molecule corresponding to: position 167,123 according to SEQ ID NO:2; position 166,500 according to SEQ ID NO:3; position 2,708 according to SEQ ID NO:6; position 2,398 according to SEQ ID NO:7; position 2,085 according to SEQ ID NO:8; position 1,775 according to SEQ ID NO:9; position 2,708 according to SEQ ID NO:12; position 2,398 according to SEQ ID NO:13; position 2,085 according to SEQ ID NO:14; or position 1,775 according to SEQ ID NO:15; and
  c) determining whether the extension product of the primer comprises: a deletion of the position corresponding to position 167,122 according to SEQ ID NO:1; a deletion of the position corresponding to position 166,500 according to SEQ ID NO:3; a deletion of the position corresponding to position 2,707 according to SEQ ID NO:4; a deletion of the position corresponding to position 2,397 according to SEQ ID NO:5; a guanine at a position corresponding to position 2,085 according to SEQ ID NO:8; a guanine at a position corresponding to position 1,175 according to SEQ ID NO:9; a deletion of the position corresponding to position 2,707 according to SEQ ID NO:10; a deletion of the position corresponding to position 2,397 according to SEQ ID NO:11; a guanine at a position corresponding to position 2,085 according to SEQ ID NO:14; or a guanine at a position corresponding to position 1,175 according to SEQ ID NO:15.

* * * * *